United States Patent
Goodwin et al.

(10) Patent No.: US 8,822,646 B2
(45) Date of Patent: *Sep. 2, 2014

(54) CANCER THERAPIES AND PHARMACEUTICAL COMPOSITIONS USED THEREIN

(75) Inventors: Neal Clifford Goodwin, Plainwell, MI (US); James Patrick McGovren, Kalamazoo, MI (US)

(73) Assignee: ProNAi Therapeutics, Inc., Kalamazoo, MI (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/428,885

(22) Filed: Mar. 23, 2012

(65) Prior Publication Data

US 2012/0294851 A1 Nov. 22, 2012

Related U.S. Application Data

(63) Continuation of application No. 12/085,894, filed as application No. PCT/US2006/046111 on Dec. 1, 2006, now abandoned.

(60) Provisional application No. 60/778,304, filed on Mar. 2, 2006, provisional application No. 60/741,229, filed on Dec. 1, 2005.

(51) Int. Cl.
*A61K 38/00* (2006.01)
*C07K 16/00* (2006.01)

(52) U.S. Cl.
USPC .......................................... 530/387.1; 514/44

(58) Field of Classification Search
None
See application file for complete search history.

(56) References Cited

U.S. PATENT DOCUMENTS

2003/0176376 A1* 9/2003 Klem .............................. 514/44
2006/0198828 A1* 9/2006 Sheikhnejad et al. ..... 424/93.21

OTHER PUBLICATIONS

Rituximab, drug description, Genetech, 1997.*

* cited by examiner

*Primary Examiner* — Lei Yao
(74) *Attorney, Agent, or Firm* — Honigman Miller Schwartz & Cohn LLP; Kelly T. Murphy; Jonathan P. O'Brien

(57) ABSTRACT

The invention relates to compositions and methods to inhibit gene expression. In particular, the invention provides co-therapies comprising oligonucleotides plus other therapies to treat cancer.

5 Claims, 9 Drawing Sheets

Figure 3, see separate Power point figure

CANCER THERAPIES AND PHARMACEUTICAL COMPOSITIONS USED THEREIN

This application is a continuation of U.S. patent application Ser. No. 12/085,894 filed Jun. 2, 2008, which is the U.S. National phase of International Application Number PCT/US2006/046111 filed on Dec. 1, 2006, which claims priority to U.S. Provisional patent application No. 60/741,229, filed on Dec. 1, 2005 and to U.S. Provisional application No. 60/778,304, filed on Mar. 2, 2006, all of which are herein incorporated by reference in their entireties.

SEQUENCE LISTING

This application incorporates by reference in its entirety the Sequence Listing, filed herewith, entitled Pronai Cotherapies_ST25.txt (702 kilobytes) which was created Apr. 6, 2009 and filed with U.S. application Ser. No. 12/085,894, and the Sequence Listing filed with the International Application PCT/US2006/046111 on Dec. 1, 2006.

TECHNICAL FIELD OF THE INVENTION

The present invention relates to cancer therapies and methods of using the same. In particular, the present invention provides combination cancer therapies comprising oligomers and another therapeutic agent and methods of using the same.

BACKGROUND OF THE INVENTION

Oncogenes have become the central concept in understanding cancer biology and may provide valuable targets for therapeutic drugs. In many types of human tumors, including lymphomas and leukemias, oncogenes are over-expressed and may be associated with tumorigenicity (Tsujimoto et al., Science 228:1440-1443 [1985]). For instance, high levels of expression of the human bcl-2 gene have been found in all lymphomas with a t(14; 18) chromosomal translocations including most follicular B cell lymphomas and many large cell non-Hodgkin's lymphomas. High levels of bcl-2 gene expression have also been found in certain leukemias that do not have a t(14; 18) chromosomal translation, including most cases of chronic lymphocytic leukemia acute, many lymphocytic leukemias of the pre-B cell type, neuroblastomas, nasophryngeal carcinomas, and many adenocarcinomas of the prostate, breast and colon. (Reed et al., Cancer Res. 51:6529 [1991]; Yunis et al., New England J. Med. 320:1047; Campos et al., Blood 81:3091-3096 [1993]; McDonnell et al., Cancer Res. 52:6940-6944 [1992]; Lu et al., Int. J. Cancer 53:29-35 [1993]; Bonner et al., Lab Invest. 68:43 A [1993]. Other oncogenes include TGF-α, c-ki-ras, ras, her-2 and c-myc.

Gene expression, including oncogene expression, can be inhibited by molecules that interfere with promoter function. Accordingly, the expression of oncogenes may be inhibited by single stranded oligonucleotides.

Cancer treatment typically includes chemotherapeutic agents and often radiation therapy. In many cases, however, the current treatments are not efficacious or do not cure the cancer. Consequently, there is a need for more effective cancer treatments.

SUMMARY OF THE INVENTION

In general, the invention relates to co-therapies for treating cancer and methods of using the same. In one aspect, the present invention provides co-therapies comprising an oligonucleotide compound that hybridizes to SEQ ID NO:1249 or the complement thereof, and another cancer therapy (e.g., chemotherapy agent, radiation, surgery, and the like).

In another aspect the invention provides a pharmaceutical composition comprising an oligonucleotide compound and a chemotherapy agent, wherein the oligonucleotide compound is an oligomer that hybridizes under physiological conditions to SEQ ID NO: 1249, SEQ ID NO: 936 or the complement thereof. In one embodiment, the chemotherapy agent comprises an anti-metabolite. The anti-metabolite can include methotraxate, 5-fluorouracil, gemcitabine, 6-mercaptopurine, 6-thioguanine, fludarabine, cladribine, cytarabine or combinations thereof.

In another embodiment, the chemotherapy agent comprises an anthracycline. The anthracycline can comprise daunorubicin, doxorubicin, idarubicin, epirubicin, mitoxantrone or combinations thereof.

In yet another embodiment the chemotherapy agent comprises a taxane. The taxane can include paclitaxel, docetaxel, Taxotere™, Taxol™ or combinations thereof.

In still another embodiment, the chemotherapy agent comprises a camptothecin. The campothecin can include irinotecan, topotecan, etoposide, vincristine, vinblastine, vinorelbine or combinations thereof.

In still yet another embodiment, the chemotherapy agent comprises an EGFR inhibitor. The EGFR inhibitor can include gefitinib, erlotinib, cetuximab or combinations thereof.

In another embodiment, the chemotherapy agent comprises one or more immunotherapies. The immunotherapies can include rituximab, tositumomab, ibritumomab, bevacizumab or combinations thereof.

In an additional embodiment, the chemotherapy agent comprises one or more kinase inhibitors. The tyrosine kinase inhibitor can include imatinib mesylate, lefunomide and midostaurin.

In a further embodiment the chemotherapy agent comprises a cocktail that includes an immunotherapy, an alkylating agent, an anthracycline, a camptothecin and prednisone. The immunotherapy can include rituximab, the alkylating agent can include cyclophosphamide, the anthracycline can include doxorubicin and the campothecin can include vincristine.

In another embodiment the oligomer can comprise an oligomer that hybridizes under physiological conditions to nucleotides 500-2026, 500-1525, 800-1225, 900-1125, 950-1075 or 970-1045 of SEQ ID NO: 1249 or the complement thereof. In yet another embodiment the oligomer can comprise SEQ ID NOs: 1250, 1251, 1252, 1253, 1267-1477 or the complement thereof. In an additional embodiment, the oligomer includes an oligomer that hybridizes under physiological conditions with nucleotides 1-650 of SEQ ID NO: 936 or the complement thereof. In another embodiment, the oligomer comprises SEQ ID NO: 940, 943 or the complement thereof.

In another embodiment, the oligomer includes an additional oligomer. The additional oligomer can include any one of SEQ ID NOs: 1250-1253, 1267-1477, 2-281, 283-461, 463-935, 937-1080, 1082-1248 and the complements thereof.

In yet another embodiment, the oligonucleotides are between 15 and 35 base pairs in length. In still another embodiment, the oligonucleotides have a phosphorothiolate backbone.

In another aspect, the invention provides a method of treating cancer including administering to a patient an effective amount of an oligonucleotide compound and administering to the patient an effective amount of a chemotherapy agent.

One embodiment of this aspect includes chemotherapy agents including a cocktail having rituximab, cyclophosphamide, an anthracycline, a camptothecin and prednisone. In another embodiment, the chemotherapy agent comprises rituximab. Another embodiment further includes administering to the patient a radiation therapy. Still another embodiment further includes excising cancerous tissue from a patient.

Other embodiments of this aspect include an oligonucleotide compound that can include any oligomer that hybridizes under physiological conditions to SEQ ID NO: 1249, SEQ ID NO: 936 or the complement thereof. Another embodiment includes an oligomer that hybridizes under physiological conditions to nucleotides 500-2026, 500-1525, 800-1225, 900-1125, 950-1075 or 970-1045 of SEQ ID NO: 1249 or the complement thereof. Still another embodiment includes an oligomer selected from SEQ ID NOs: 1250, 1251, 1252, 1253, 1267-1477, 2-281, 283-461, 463-935, 937-1080, 1082-1248 and the complements thereof.

In another embodiment the method further includes administering an additional oligomer. The additional oligomer can comprise any one of SEQ ID NOs: 1250-1253, 1267-1477, 2-281, 283-461, 463-935, 937-1080, 1082-1248 and the complements thereof.

In yet another embodiment the oligonucleotides are between 15 and 35 base pairs in length. In still another embodiment, the oligonucleotides have a phosphorothioate backbone.

In a third aspect the invention provides a method of treating cancer comprising administering to a patient an effective amount of an oligonucleotide compound including SEQ ID NO: 1251 and administering to the patient an effective amount of rituximab.

DETAILED DESCRIPTION

I. Definitions

Figure 1:
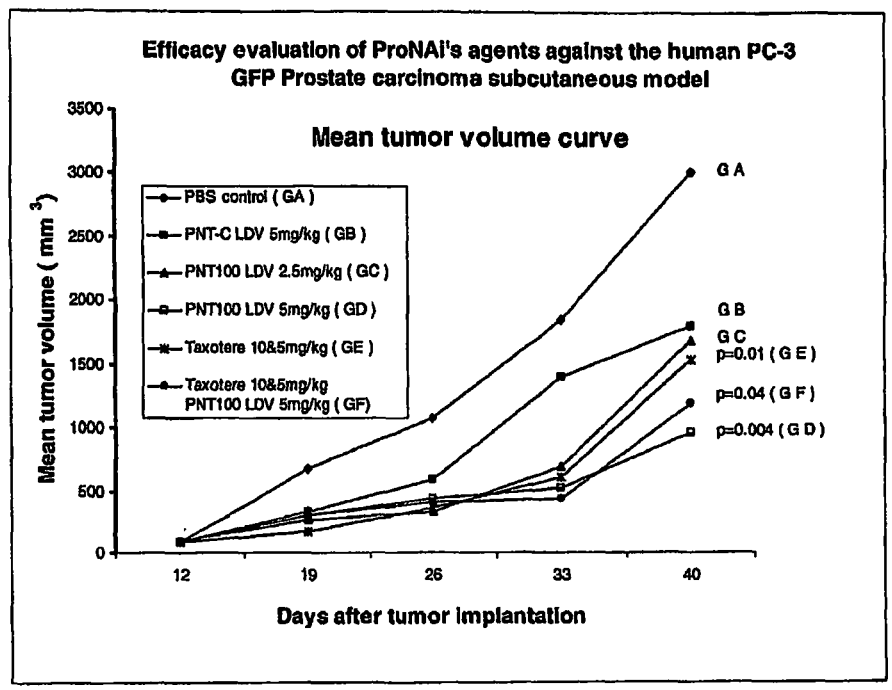
FIG. 1 shows mean tumor volume of tumors in the PC-3 GFP prostate carcinoma subcutaneous model following treatment with SEQ ID NO: 1251 and Taxotere™.

As used herein, a "chemotherapy agent" is a non-oligonucleotide based cytotoxic drug or non-oligonucleotide based cytotoxic cocktail of drugs that that are intended to destroy or inhibit malignant cells and tissues.

As used herein, "patient" refers to a mammal, including a human.

As used herein, the term "subject" refers to any animal (e.g., a mammal), including, but not limited to, humans, non-human primates, rodents, and the like, which is to be the recipient of a particular treatment. Typically, the terms "subject" and "patient" are used interchangeably herein in reference to a human subject.

As used herein, the term "non-human animals" refers to all non-human animals including, but are not limited to, vertebrates such as rodents, non-human primates, ovines, bovines, ruminants, lagomorphs, porcines, caprines, equines, canines, felines, ayes, etc. and non-vertebrate animals such as *Drosophila* and nematode.

As used herein, an effective amount is defined as the amount required to confer a therapeutic effect on the treated patient, and is typically determined based on age, surface area, weight and condition of the patient. The interrelationship of dosages for animals and humans (based on milligrams per meter squared of body surface) is described by Freireich et al., *Cancer Chemother. Rep.*, 50: 219 (1966). Body surface area can be approximately determined from height and weight of the patient. See, e.g., Scientific Tables, Geigy Pharmaceuticals, Ardsley, N.Y., 537 (1970).

As used herein, the term "wherein said chemotherapy agent is present at less than one half the standard dose" refers to a dosage that is less than one half (e.g., less than 50%, less than 40%, less than 10% or less than 1%) of the minimum value of the standard dosage range used for dosing humans. In some embodiments, the standard dosage range is the dosage range recommended by the manufacturer. In other embodiments, the standard dosage range is the range utilized by a medical doctor in the field. In still other embodiments, the standard dosage range is the range considered the normal standard of care in the field. The particular dosage within the dosage range is determined, for example by the age, weight, and health of the subject as well as the type of cancer being treated.

As used herein, the term "under conditions such that expression of said gene is inhibited" refers to conditions in which an oligonucleotide of the present invention hybridizes to a gene (e.g., a regulatory region of the gene) and inhibits transcription of the gene by at least 10%, at least 25%, at least 50%, or at least 90% relative to the level of transcription in the absence of the oligonucleotide. The present invention is not limited to the inhibition of expression of a particular gene. Exemplary genes include, without limitation, c-ki-ras, c-Ha-ras, c-myc, her-2, TGF-α, and bcl-2.

As used herein, the term "under conditions such that growth of said cell is reduced" refers to conditions where an oligonucleotide of the present invention, when administered to a cell (e.g., a cancer) reduces the rate of growth of the cell by at least 10%, at least 25%, at least 50% or at least 90% relative to the rate of growth of the cell in the absence of the oligonucleotide.

As used herein, the term "nucleic acid molecule" refers to any nucleic acid containing molecule, including but not limited to, DNA or RNA. The term encompasses sequences that include any of the known base analogs of DNA and RNA.

The term "gene" refers to a nucleic acid (e.g., DNA) sequence that comprises coding sequences necessary for the production of a polypeptide, precursor or RNA (e.g., rRNA, tRNA). The polypeptide can be encoded by a full length coding sequence or by any portion of the coding sequence so long as the desired activity or functional properties (e.g., enzymatic activity, ligand binding, signal transduction, immunogenicity, etc.) of the full-length or fragment is retained. The term also encompasses the coding region of a structural gene and the sequences located adjacent to the coding region on both the 5' and 3' ends for a distance of about 1 kb or more on either end such that the gene corresponds to the length of the full-length mRNA. Sequences located 5' of the coding region and present on the mRNA are referred to as 5' non-translated sequences. Sequences located 3' or downstream of the coding region and present on the mRNA are referred to as 3' non-translated sequences. The term "gene" encompasses both cDNA and genomic forms of a gene. A genomic form or clone of a gene contains the coding region interrupted with non-coding sequences termed "introns" or "intervening regions" or "intervening sequences." Introns are segments of a gene that are transcribed into nuclear RNA (hnRNA); introns may contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide.

As used herein, the "regulatory region" of a gene is any part of a gene that regulates the expression of a gene, including, without limitation, transcriptional and translational regulation. The regions include without limitation the 5' and 3' regions of genes, binding sites for regulatory factors, including without limitation transcription factor binding sites. The regions also include regions that are as long as 20,000 or more base pairs upstream or downstream of translational start sites, so long as the region is involved in any way in the regulation of the expression of the gene. The region may be as short as 20 base pairs or as long as thousands of base pairs.

As used herein, the term "heterologous gene" refers to a gene that is not in its natural environment. For example, a heterologous gene includes a gene from one species introduced into another species. A heterologous gene also includes a gene native to an organism that has been altered in some way (e.g., mutated, added in multiple copies, linked to non-native regulatory sequences, etc). Heterologous genes are distinguished from endogenous genes in that the heterologous gene sequences are typically joined to DNA sequences that are not found naturally associated with the gene sequences in the chromosome or are associated with portions of the chromosome not found in nature (e.g., genes expressed in loci where the gene is not normally expressed).

As used herein, the term "gene expression" refers to the process of converting genetic information encoded in a gene into RNA (e.g., mRNA, rRNA, tRNA, or snRNA) through "transcription" of the gene (i.e., via the enzymatic action of an RNA polymerase), and for protein encoding genes, into protein through "translation" of mRNA. Gene expression can be regulated at many stages in the process. "Up-regulation" or "activation" refers to regulation that increases the production of gene expression products (i.e., RNA or protein), while "down-regulation" or "repression" refers to regulation that decrease production. Molecules (e.g., transcription factors) that are involved in up-regulation or down-regulation are often called "activators" and "repressors," respectively.

In addition to containing introns, genomic forms of a gene may also include sequences located on both the 5' and 3' end of the sequences that are present on the RNA transcript. These sequences are referred to as "flanking" sequences or regions (these flanking sequences are located 5' or 3' to the non-translated sequences present on the mRNA transcript). The 5' flanking region may contain regulatory sequences such as promoters and enhancers that control or influence the transcription of the gene. The 3' flanking region may contain sequences that direct the termination of transcription, post-transcriptional cleavage and polyadenylation.

The term "wild-type" refers to a gene or gene product isolated from a naturally occurring source. A wild-type gene is that which is most frequently observed in a population and is thus arbitrarily designed the "normal" or "wild-type" form of the gene. In contrast, the term "modified" or "mutant" refers to a gene or gene product that displays modifications in sequence and or functional properties (i.e., altered characteristics) when compared to the wild-type gene or gene product. It is noted that naturally occurring mutants can be isolated; these are identified by the fact that they have altered characteristics (including altered nucleic acid sequences) when compared to the wild-type gene or gene product.

As used herein, the terms "an oligonucleotide having a nucleotide sequence encoding a gene" and "polynucleotide having a nucleotide sequence encoding a gene," means a nucleic acid sequence comprising the coding region of a gene or in other words the nucleic acid sequence that encodes a gene product. The coding region may be present in a cDNA, genomic DNA or RNA form. When present in a DNA form, the oligonucleotide or polynucleotide may be single-stranded (i.e., the sense strand) or double-stranded. Suitable control elements such as enhancers/promoters, splice junctions, polyadenylation signals, etc. may be placed in close proximity to the coding region of the gene if needed to permit proper initiation of transcription and/or correct processing of the primary RNA transcript. Alternatively, the coding region utilized in the expression vectors of the present invention may contain endogenous enhancers/promoters, splice junctions, intervening sequences, polyadenylation signals, etc. or a combination of both endogenous and exogenous control elements.

As used herein, the term "oligonucleotide," refers to a short length of single-stranded polynucleotide chain. Oligonucleotides are typically less than 200 residues long (e.g., between 8 and 100), however, as used herein, the term is also intended to encompass longer polynucleotide chains (e.g., as large as 5000 residues). Oligonucleotides are often referred to by their length. For example a 24 residue oligonucleotide is referred to as a "24-mer." Oligonucleotides can form secondary and tertiary structures by self-hybridizing or by hybridizing to other polynucleotides. Such structures can include, but are not limited to, duplexes, hairpins, cruciforms, bends, and triplexes.

In some embodiments, oligonucleotides are "antigenes." As used herein, the term "antigene" refers to an oligonucleotide that hybridizes to the promoter region of a gene. In some embodiments, the hybridization of the antigene to the promoter inhibits expression of the gene.

As used herein, the terms "complementary" or "complementarity" are used in reference to polynucleotides (i.e., a sequence of nucleotides) related by the base-pairing rules. For example, for the sequence "A-G-T," is complementary to the sequence "T-C-A." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands. This is of particular importance in amplification reactions, as well as detection methods that depend upon binding between nucleic acids.

As used herein, the term "completely complementary," for example when used in reference to an oligonucleotide of the present invention refers to an oligonucleotide where all of the nucleotides are complementary to a target sequence (e.g., a gene).

As used herein, the term "partially complementary," for example when used in reference to an oligonucleotide of the present invention, refers to an oligonucleotide where at least one nucleotide is not complementary to the target sequence. Exemplary partially complementary oligonucleotides are those that can still hybridize to the target sequence under physiological conditions. The term "partially complementary" refers to oligonucleotides that have regions of one or more non-complementary nucleotides both internal to the oligonucleotide or at either end. Oligonucleotides with mismatches at the ends may still hybridize to the target sequence.

The term "homology" refers to a degree of complementarity. There may be partial homology or complete homology (i.e., identity). A partially complementary sequence is a nucleic acid molecule that at least partially inhibits a completely complementary nucleic acid molecule from hybridizing to a target nucleic acid is "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (i.e., the hybridization) of a completely homologous nucleic acid molecule to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target that is substantially non-complementary (e.g., less than about 30% identity); in the absence of non-specific binding the probe will not hybridize to the second non-complementary target.

When used in reference to a double-stranded nucleic acid sequence such as a cDNA or genomic clone, the term "substantially homologous" refers to any probe that can hybridize to either or both strands of the double-stranded nucleic acid sequence under conditions of low stringency as described above.

When used in reference to a single-stranded nucleic acid sequence, the term "substantially homologous" refers to any probe that can hybridize (i.e., it is the complement of) the single-stranded nucleic acid sequence under conditions of low stringency as described above.

As used herein, the term "hybridization" is used in reference to the pairing of complementary nucleic acids. Hybridization and the strength of hybridization (i.e., the strength of the association between the nucleic acids) is impacted by such factors as the degree of complementary between the nucleic acids, stringency of the conditions involved, the $T_m$ of the formed hybrid, and the G:C ratio within the nucleic acids. A single molecule that contains pairing of complementary nucleic acids within its structure is said to be "self-hybridized."

As used herein, the term "$T_m$" is used in reference to the "melting temperature." The melting temperature is the temperature at which a population of double-stranded nucleic acid molecules becomes half dissociated into single strands. The equation for calculating the $T_m$ of nucleic acids is well known in the art. As indicated by standard references, a simple estimate of the $T_m$ value may be calculated by the equation: $T_m=81.5+0.41(\% \text{ G+C})$, when a nucleic acid is in aqueous solution at 1 M NaCl (See e.g., Anderson and Young, Quantitative Filter Hybridization, in Nucleic Acid Hybridization [1985]). Other references include more sophisticated computations that take structural as well as sequence characteristics into account for the calculation of $T_m$.

As used herein the term "stringency" is used in reference to the conditions of temperature, ionic strength, and the presence of other compounds such as organic solvents, under which nucleic acid hybridizations are conducted. Under "low stringency conditions" a nucleic acid sequence of interest will hybridize to its exact complement, sequences with single base mismatches, closely related sequences (e.g., sequences with 90% or greater homology), and sequences having only partial homology (e.g., sequences with 50-90% homology). Under "medium stringency conditions," a nucleic acid sequence of interest will hybridize only to its exact complement, sequences with single base mismatches, and closely related sequences (e.g., 90% or greater homology). Under "high stringency conditions," a nucleic acid sequence of interest will hybridize only to its exact complement, and (depending on conditions such a temperature) sequences with single base mismatches. In other words, under conditions of high stringency the temperature can be raised so as to exclude hybridization to sequences with single base mismatches.

"High stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 0.1×SSPE, 1.0% SDS at 42° C. when a probe of about 500 nucleotides in length is employed.

"Medium stringency conditions" when used in reference to nucleic acid hybridization comprise conditions equivalent to binding or hybridization at 42° C. in a solution consisting of 5×SSPE (43.8 NaCl, 6.9 g/l $NaH_2PO_4H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 1.0×SSPE, 1.0% SDS at 42° C. when a probe of about 500 nucleotides in length is employed.

"Low stringency conditions" comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.1% SDS, 5×Denhardt's reagent [50×Denhardt's contains per 500 ml: 5 g Ficoll (Type 400, Pharamcia), 5 g BSA (Fraction V; Sigma)] and 100 µg/ml denatured salmon sperm DNA followed by washing in a solution comprising 5×SSPE, 0.1% SDS at 42° C. when a probe of about 500 nucleotides in length is employed.

The present invention is not limited to the hybridization of probes of about 500 nucleotides in length. The present invention contemplates the use of probes between approximately 8 nucleotides up to several thousand (e.g., at least 5000) nucleotides in length. One skilled in the relevant understands that stringency conditions may be altered for probes of other sizes (See e.g., Anderson and Young, Quantitative Filter Hybridization, in *Nucleic Acid Hybridization* [1985] and Sambrook et al., *Molecular Cloning—A Laboratory Manual, Cold Spring Harbor Laboratory, Cold Spring Harbor, N.Y.,* 2001, and *Current Protocols in Molecular Biology*, M. Ausubel et al., eds., (Current Protocols, a joint venture between Greene Publishing Associates, Inc. and John Wiley & Sons, Inc., and supplements through 2006)).

It is well known in the art that numerous equivalent conditions may be employed to comprise low stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol) are considered and the hybridization solution may be varied to generate conditions of low stringency hybridization different from, but equivalent to, the above listed conditions. In addition, the art knows conditions that promote hybridization under conditions of high stringency (e.g., increasing the temperature of the hybridization and/or wash steps, the use of formamide in the hybridization solution, etc.) (See definition above for "stringency").

As used herein, the term "physiological conditions" refers to specific stringency conditions that approximate or are conditions inside an animal (e.g., a human). Exemplary physiological conditions for use in vitro include, but are not limited to, 37° C., 95% air, 5% $CO_2$, commercial medium for culture of mammalian cells (e.g., DMEM media available from Gibco, MD), 5-10% serum (e.g., calf serum or horse serum), additional buffers, and optionally hormone (e.g., insulin and epidermal growth factor).

As used herein, the term "isolated" when used in relation to a nucleic acid, as in "an isolated oligonucleotide" or "isolated polynucleotide" refers to a nucleic acid sequence that is identified and separated from at least one component or contaminant with which it is ordinarily associated in its natural source. Isolated nucleic acid is such present in a form or setting that is different from that in which it is found in nature. In contrast, non-isolated nucleic acids as nucleic acids such as DNA and RNA found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs that encode a multitude of proteins. However, isolated nucleic acid encoding a given protein includes, by way of example, such nucleic acid in cells ordinarily expressing the given protein where the nucleic acid is in a chromosomal location different from that of natural cells, or is otherwise flanked by a different nucleic acid sequence than that found in nature. The isolated nucleic acid, oligonucleotide, or polynucleotide may be present in single-stranded or double-stranded form. When an isolated nucleic acid, oligonucleotide or polynucleotide is to be utilized to express a protein, the oligonucleotide or polynucleotide will contain at a minimum the sense or coding strand (i.e., the oligonucleotide or polynucleotide may be single-stranded), but may contain both the sense and anti-sense strands (i.e., the oligonucleotide or polynucleotide may be double-stranded).

As used herein, the term "purified" or "to purify" refers to the removal of components (e.g., contaminants) from a sample. For example, recombinant polypeptides are expressed in bacterial host cells and the polypeptides are purified by the removal of host cell proteins; the percent of recombinant polypeptides is thereby increased in the sample.

The term "epitope" as used herein refers to that portion of an antigen that makes contact with a particular antibody.

When a protein or fragment of a protein is used to immunize a host animal, numerous regions of the protein may induce the production of antibodies which bind specifically to a given region or three-dimensional structure on the protein; these regions or structures are referred to as "antigenic determinants." An antigenic determinant may compete with the intact antigen (i.e., the "immunogen" used to elicit the immune response) for binding to an antibody.

As used herein, the term "western blot" refers to the analysis of protein(s) (or polypeptides) immobilized onto a support such as nitrocellulose or a membrane. The proteins are run on acrylamide gels to separate the proteins, followed by transfer of the protein from the gel to a solid support, such as nitrocellulose or a nylon membrane. The immobilized proteins are then exposed to antibodies with reactivity against an antigen of interest. The binding of the antibodies may be detected by various methods, including the use of radiolabeled antibodies.

As used herein, the term "cell culture" refers to any in vitro culture of cells. Included within this term are continuous cell lines (e.g., with an immortal phenotype), primary cell cultures, transformed cell lines, finite cell lines (e.g., non-transformed cells), and any other cell population maintained in vitro.

As used, the term "eukaryote" refers to organisms distinguishable from "prokaryotes." It is intended that the term encompass all organisms with cells that exhibit the usual characteristics of eukaryotes, such as the presence of a true nucleus bounded by a nuclear membrane, within which lie the chromosomes, the presence of membrane-bound organelles, and other characteristics commonly observed in eukaryotic organisms. Thus, the term includes, but is not limited to such organisms as fungi, protozoa, and animals (e.g., humans).

As used herein, the term "in vitro" refers to an artificial environment and to processes or reactions that occur within an artificial environment. In vitro environments can consist of, but are not limited to, test tubes and cell culture. The term "in vivo" refers to the natural environment (e.g., an animal or a cell) and to processes or reaction that occur within a natural environment.

The terms "test compound" and "candidate compound" refer to any chemical entity, pharmaceutical, drug, and the like that is a candidate for use to treat or prevent a disease, illness, sickness, or disorder of bodily function (e.g., cancer). Test compounds comprise both known and potential therapeutic compounds. A test compound can be determined to be therapeutic by screening using the screening methods of the present invention. In some embodiments of the present invention, test compounds include antisense compounds.

As used herein, the term "chemotherapeutic agents" refers to compounds that are useful in the treatment of disease (e.g., cancer). Exemplary chemotherapeutic agents affective against cancer include, but are not limited to, daunorubicin, dactinomycin, doxorubicin, bleomycin, mitomycin, nitrogen mustard, chlorambucil, melphalan, cyclophosphamide, 6-mercaptopurine, 6-thioguanine, cytarabine (CA), 5-fluorouracil (5-FU), floxuridine (5-FUdR), methotrexate (MTX), colchicine, vincristine, vinblastine, etoposide, teniposide, cisplatin and diethylstilbestrol (DES).

As used herein, the term "sample" is used in its broadest sense. In one sense, it is meant to include a specimen or culture obtained from any source, as well as biological and environmental samples. Biological samples may be obtained from animals (including humans) and encompass fluids, solids, tissues, and gases. Biological samples include blood products, such as plasma, serum and the like. Environmental samples include environmental material such as surface matter, soil, water, crystals and industrial samples. Such examples are not however to be construed as limiting the sample types applicable to the present invention.

For purposes of this invention, the chemical elements are identified in accordance with the Periodic Table of the Elements, CAS version, Handbook of Chemistry and Physics, $75^{th}$ Ed. Additionally, general principles of organic chemistry are described in "Organic Chemistry", Thomas Sorrell, University Science Books, Sausalito: 1999, and "March's Advanced Organic Chemistry", 5th Ed., Ed.: Smith, M. B. and March, J., John Wiley & Sons, New York: 2001.

As used herein the term "aliphatic" encompasses the terms alkyl, alkenyl, alkynyl, each of which being optionally substituted as set forth below.

As used herein, an "alkyl" group refers to a saturated aliphatic hydrocarbon group containing 1-8 (e.g., 1-6 or 1-4) carbon atoms. An alkyl group can be straight or branched. Examples of alkyl groups include, but are not limited to, methyl, ethyl, propyl, isopropyl, butyl, isobutyl, sec-butyl, tert-butyl, n-pentyl, n-heptyl or 2-ethylhexyl. An alkyl group can be substituted (i.e., optionally substituted) with one or more substituents such as halo, cycloaliphatic, heterocycloaliphatic, aryl, heteroaryl, alkoxy, aroyl, heteroaroyl, cycloaliphaticcarbonyl, (heterocycloaliphatic)carbonyl, nitro, cyano, amino, amido, acyl, sulfonyl, sulfinyl, sulfanyl, sulfoxy, urea, thiourea, sulfamoyl, sulfamide, oxo, carboxy, carbamoyl, cycloaliphaticoxy, heterocycloaliphaticoxy, aryloxy, heteroaryloxy, aralkyloxy, heteroarylalkoxy, or hydroxy. Without limitation, some examples of substituted alkyls include carboxyalkyl (such as HOOC-alkyl, alkoxycarbonylalkyl and alkylcarbonyloxyalkyl), cyanoalkyl, hydroxyalkyl, alkoxyalkyl, acylalkyl, hydroxyalkyl, aralkyl, (alkoxyaryl)alkyl, (sulfonylamino)alkyl (such as (alkylsulfonylamino)alkyl), aminoalkyl, amidoalkyl, (cycloaliphatic) alkyl, cyanoalkyl, or haloalkyl.

As used herein, an "alkenyl" group refers to an aliphatic carbon group that contains 2-8 (e.g., 2-6 or 2-4) carbon atoms and at least one double bond. Like an alkyl group, an alkenyl group can be straight or branched. Examples of an alkenyl group include, but are not limited to, allyl, isoprenyl, 2-butenyl and 2-hexenyl. An alkenyl group can be optionally substituted with one or more substituents such as halo, cycloaliphatic, heterocycloaliphatic, aryl, heteroaryl, alkoxy, aroyl, heteroaroyl, (cycloaliphatic)carbonyl, (heterocycloaliphatic)carbonyl, nitro, cyano, amino, amido, acyl, sulfonyl, sulfinyl, sulfanyl, sulfoxy, urea, thiourea, sulfamoyl, sulfamide, oxo, carboxy, carbamoyl, (cycloaliphatic)oxy, (heterocycloaliphatic)oxy, aryloxy, heteroaryloxy, aralkyloxy, (heteroaryl)alkoxy, or hydroxy.

As used herein, an "alkynyl" group refers to an aliphatic carbon group that contains 2-8 (e.g., 2-6 or 2-4) carbon atoms and has at least one triple bond. An alkynyl group can be straight or branched. Examples of an alkynyl group include, but are not limited to, propargyl and butynyl. An alkynyl group can be optionally substituted with one or more substituents such as halo, cycloaliphatic, heterocycloaliphatic, aryl, heteroaryl, alkoxy, aroyl, heteroaroyl, (cycloaliphatic) carbonyl, (heterocycloaliphatic)carbonyl, nitro, cyano, amino, amido, acyl, sulfonyl, sulfinyl, sulfanyl, sulfoxy, urea, thiourea, sulfamoyl, sulfamide, oxo, carboxy, carbamoyl, (cycloaliphatic)oxy, (heterocycloaliphatic)oxy, aryloxy, heteroaryloxy, aralkyloxy, (heteroaryl)alkoxy, or hydroxy.

As used herein, an "amido" encompasses both "aminocarbonyl" and "carbonylamino". These terms when used alone or in connection with another group refers to an amido group such as $N(R^X)_2$—C(O)— or $R^Y C(O)$—$N(R^X)_2$— when used terminally and —C(O)—$N(R^X)$— or —$N(R^X)$—C(O)— when used internally, wherein $R^X$ and $R^Y$ are defined below. Examples of amido groups include alkylamido (such as alkylcarbonylamino and alkylcarbonylamino), (heterocycloaliphatic)amido, (heteroaralkyl)amido, (heteroaryl)amido, (heterocycloalkyl)alkylamido, arylamido, aralkylamido, (cycloalkyl)alkylamido, and cycloalkylamido.

As used herein, an "amino" group refers to —$NR^X R^Y$ wherein each of $R^X$ and $R^Y$ is independently hydrogen, alkyl, cycloaliphatic, (cycloaliphatic)aliphatic, aryl, araliphatic, heterocycloaliphatic, (heterocycloaliphatic)aliphatic, heteroaryl, carboxy, sulfanyl, sulfinyl, sulfonyl, (aliphatic)carbonyl, (cycloaliphatic)carbonyl, ((cycloaliphatic)aliphatic) carbonyl, arylcarbonyl, (araliphatic)carbonyl, (heterocycloaliphatic)carbonyl, ((heterocycloaliphatic)aliphatic)carbonyl, (heteroaryl)carbonyl, or (heteroaraliphatic) carbonyl, each of which being defined herein and being optionally substituted. Examples of amino groups include alkylamino, dialkylamino, and arylamino.

When the term "amino" is not the terminal group (e.g., alkylcarbonylamino), it is represented by —$NR^X$—. $R^X$ has the same meaning as defined above.

As used herein, an "aryl" group used alone or as part of a larger moiety as in "aralkyl", "aralkoxy", or "aryloxyalkyl" refers to monocyclic (e.g., phenyl); bicyclic (e.g., indenyl, naphthalenyl, tetrahydronaphthyl, tetrahydroindenyl); and tricyclic (e.g., fluorenyl tetrahydrofluorenyl, or tetrahydroanthracenyl, anthracenyl). The bicyclic and tricyclic groups include benzofused 2-3 membered carbocyclic rings. For example, a benzofused group includes phenyl fused with two or more $C_{4-8}$ carbocyclic moieties. An aryl is optionally substituted with one or more substituents including aliphatic [e.g., alkyl, alkenyl, or alkynyl]; cycloaliphatic; (cycloaliphatic)aliphatic; heterocycloaliphatic; (heterocycloaliphatic)aliphatic; aryl; heteroaryl; alkoxy; (cycloaliphatic)oxy; (heterocycloaliphatic)oxy; aryloxy; heteroaryloxy; (araliphatic)oxy; (heteroaraliphatic)oxy; aroyl; heteroaroyl; amino; oxo (on a non-aromatic carbocyclic ring of a benzofused bicyclic or tricyclic aryl); nitro; carboxy; amido; acyl [e.g., aliphaticcarbonyl; (cycloaliphatic)carbonyl; ((cycloaliphatic)aliphatic)carbonyl; (araliphatic)carbonyl; (heterocycloaliphatic)carbonyl; ((heterocycloaliphatic) aliphatic)carbonyl; and (heteroaraliphatic) carbonyl]; sulfonyl [e.g., aliphaticsulfonyl and aminosulfonyl]; sulfinyl [e.g., aliphaticsulfinyl]; sulfanyl [e.g., aliphaticsulfanyl]; nitro; cyano; halo; hydroxyl; mercapto; sulfoxy; urea; thiourea; sulfamoyl; sulfamide; and carbamoyl. Alternatively, an aryl can be unsubstituted.

Non-limiting examples of substituted aryls include haloaryl [e.g., mono-, di(such as p,m-dihaloaryl), and (trihalo)aryl]; (carboxy)aryl [e.g., (alkoxycarbonyl)aryl, ((aralkyl)carbonyloxy)aryl, and (alkoxycarbonyl)aryl]; (amido) aryl [e.g., (aminocarbonyl)aryl, (((alkylamino)alkyl) aminocarbonyl)aryl, (alkylcarbonyl)aminoaryl, (arylaminocarbonyl)aryl, and (((heteroaryl)amino)carbonyl) aryl]; aminoaryl [e.g., ((alkylsulfonyl)amino)aryl and ((dialkyl)amino)aryl]; (cyanoalkyl)aryl; (alkoxy)aryl; (sulfamoyl)aryl [e.g., (aminosulfonyl)aryl]; (alkylsulfonyl)aryl; (cyano)aryl; (hydroxyalkyl)aryl; ((alkoxy)alkyl)aryl; (hydroxyl)aryl, ((carboxy)alkyl)aryl; (((dialkyl)amino)alkyl) aryl; (nitroalkyl)aryl; (((alkylsulfonyl)amino)alkyl)aryl; ((heterocycloaliphatic)carbonyl)aryl; ((alkylsulfonyl)alkyl) aryl; (cyanoalkyl)aryl; (hydroxyalkyl)aryl; (alkylcarbonyl) aryl; alkylaryl; (trihaloalkyl)aryl; p-amino-m-alkoxycarbonylaryl; p-amino-m-cyanoaryl; p-halo-m-aminoaryl; and (m-(heterocycloaliphatic)-o-(alkyl))aryl.

As used herein, an "araliphatic" such as an "aralkyl" group refers to an aliphatic group (e.g., a $C_{1-4}$ alkyl group) that is substituted with an aryl group. "Aliphatic," "alkyl," and "aryl" are defined herein. An example of an araliphatic such as an aralkyl group is benzyl.

As used herein, a "bicyclic ring system" includes 8-12 (e.g., 9, 10, or 11) membered structures that form two rings, wherein the two rings have at least one atom in common (e.g., 2 atoms in common). Bicyclic ring systems include bicycloaliphatics (e.g., bicycloalkyl or bicycloalkenyl), bicycloheteroaliphatics, bicyclic aryls, and bicyclic heteroaryls.

As used herein, a "cycloaliphatic" group encompasses a "cycloalkyl" group and a "cycloalkenyl" group, each of which being optionally substituted as set forth below.

As used herein, a "cycloalkyl" group refers to a saturated carbocyclic mono- or bicyclic (fused or bridged) ring of 3-10 (e.g., 5-10) carbon atoms. Examples of cycloalkyl groups include cyclopropyl, cyclobutyl, cyclopentyl, cyclohexyl, cycloheptyl, adamantyl, norbornyl, cubyl, octahydro-indenyl, decahydro-naphthyl, bicyclo[3.2.1]octyl, bicyclo[2.2.2]octyl, bicyclo[3.3.1]nonyl, bicyclo[3.3.2.]decyl, bicyclo[2.2.2]octyl, adamantyl, azacycloalkyl, or ((aminocarbonyl)cycloalkyl)cycloalkyl. A "cycloalkenyl" group, as used herein, refers to a non-aromatic carbocyclic ring of 3-10 (e.g., 4-8) carbon atoms having one or more double bonds. Examples of cycloalkenyl groups include cyclopentenyl, 1,4-cyclohexa-di-enyl, cycloheptenyl, cyclooctenyl, hexahydroindenyl, octahydro-naphthyl, cyclohexenyl, cyclopentenyl, bicyclo[2.2.2]octenyl, and bicyclo[3.3.1]nonenyl.

A cycloalkyl or cycloalkenyl group can be optionally substituted with one or more substituents such as aliphatic [e.g., alkyl, alkenyl, or alkynyl], cycloaliphatic, (cycloaliphatic) aliphatic, heterocycloaliphatic, (heterocycloaliphatic) aliphatic, aryl, heteroaryl, alkoxy, (cycloaliphatic)oxy, (heterocycloaliphatic)oxy, aryloxy, heteroaryloxy, (araliphatic)oxy, (heteroaraliphatic)oxy, aroyl, heteroaroyl, amino, amido [e.g., (aliphatic)carbonylamino, (cycloaliphatic)carbonylamino, ((cycloaliphatic)aliphatic)carbonylamino, (aryl)carbonylamino, (araliphatic)carbonylamino, (heterocycloaliphatic)carbonylamino, ((heterocycloaliphatic)aliphatic)carbonylamino, (heteroaryl)carbonylamino, and (heteroaraliphatic)carbonylamino], nitro, carboxy [e.g., HOOC—, alkoxycarbonyl, and alkylcarbonyloxy], acyl [e.g., (cycloaliphatic)carbonyl, ((cycloaliphatic) aliphatic)carbonyl, (araliphatic)carbonyl, (heterocycloaliphatic)carbonyl, ((heterocycloaliphatic)aliphatic)carbonyl, and (heteroaraliphatic)carbonyl], nitro, cyano, halo, hydroxy, mercapto, sulfonyl [e.g., alkylsulfonyl and arylsulfonyl], sulfinyl [e.g., alkylsulfinyl], sulfanyl [e.g., alkylsulfanyl], sulfoxy, urea, thiourea, sulfamoyl, sulfamide, oxo, or carbamoyl.

As used herein, "cyclic moiety" includes cycloaliphatic, heterocycloaliphatic, aryl, or heteroaryl, each of which has been defined previously.

As used herein, the term "heterocycloaliphatic" encompasses a heterocycloalkyl group and a heterocycloalkenyl group, each of which being optionally substituted as set forth below.

As used herein, a "heterocycloalkyl" group refers to a 3-10 membered mono- or bicyclic (fused or bridged) (e.g., 5- to 10-membered mono- or bicyclic) saturated ring structure, in which one or more of the ring atoms is a heteroatom (e.g., N, O, S, or combinations thereof). Examples of a heterocycloalkyl group include piperidyl, piperazyl, tetrahydropyranyl, tetrahydrofuryl, 1,4-dioxolanyl, 1,4-dithianyl, 1,3-dioxolanyl, oxazolidyl, isoxazolidyl, morpholinyl, thiomorpholyl, octahydro-benzofuryl, octahydro-chromenyl, octahydro-thiochromenyl, octahydro-indolyl, octahydro-pyrindinyl, decahydro-quinolinyl, octahydro-benzo[b]thiopheneyl, 2-oxa-bicyclo[2.2.2]octyl, 1-aza-bicyclo[2.2.2]octyl, 3-aza-bicyclo[3.2.1]octyl, and 2,6-dioxa-tricyclo[3.3.1.0$^{3,7}$]nonyl. A monocyclic heterocycloalkyl group can be fused with a phenyl moiety such as tetrahydroisoquinoline. A "heterocycloalkenyl" group, as used herein, refers to a mono- or bicyclic (e.g., 5- to 10-membered mono- or bicyclic) non-aromatic ring structure having one or more double bonds, and wherein one or more of the ring atoms is a heteroatom (e.g., N, O, or S). Monocyclic and bicycloheteroaliphatics are numbered according to standard chemical nomenclature.

A heterocycloalkyl or heterocycloalkenyl group can be optionally substituted with one or more substituents such as aliphatic [e.g., alkyl, alkenyl, or alkynyl], cycloaliphatic, (cycloaliphatic) aliphatic, heterocycloaliphatic, (heterocycloaliphatic) aliphatic, aryl, heteroaryl, alkoxy, (cycloaliphatic)oxy, (heterocycloaliphatic)oxy, aryloxy, heteroaryloxy, (araliphatic)oxy, (heteroaraliphatic)oxy, aroyl, heteroaroyl, amino, amido [e.g., (aliphatic)carbonylamino, (cycloaliphatic)carbonylamino, ((cycloaliphatic) aliphatic)carbonylamino, (aryl)carbonylamino, (araliphatic) carbonylamino, (heterocycloaliphatic)carbonylamino, ((heterocycloaliphatic) aliphatic)carbonylamino, (heteroaryl)carbonylamino, and (heteroaraliphatic)carbonylamino], nitro, carboxy [e.g., HOOC—, alkoxycarbonyl, and alkylcarbonyloxy], acyl [e.g., (cycloaliphatic)carbonyl, ((cycloaliphatic) aliphatic)carbonyl, (araliphatic)carbonyl, (heterocycloaliphatic)carbonyl, ((heterocycloaliphatic)aliphatic) carbonyl, and (heteroaraliphatic)carbonyl], nitro, cyano, halo, hydroxy, mercapto, sulfonyl [e.g., alkylsulfonyl and arylsulfonyl], sulfinyl [e.g., alkylsulfinyl], sulfanyl [e.g., alkylsulfanyl], sulfoxy, urea, thiourea, sulfamoyl, sulfamide, oxo, or carbamoyl.

A "heteroaryl" group, as used herein, refers to a monocyclic, bicyclic, or tricyclic ring structure having 4 to 15 ring atoms wherein one or more of the ring atoms is a heteroatom (e.g., N, O, S, or combinations thereof) and wherein one or more rings of the bicyclic or tricyclic ring structure is aromatic. A heteroaryl group includes a benzofused ring system having 2 to 3 rings. For example, a benzofused group includes benzo fused with one or two 4 to 8 membered heterocycloaliphatic moieties (e.g., indolizyl, indolyl, isoindolyl, 3H-indolyl, indolinyl, benzo[b]furyl, benzo[b]thiophenyl, quinolinyl, or isoquinolinyl). Some examples of heteroaryl are azetidinyl, pyridyl, 1H-indazolyl, furyl, pyrrolyl, thienyl, thiazolyl, oxazolyl, imidazolyl, tetrazolyl, benzofuryl, isoquinolinyl, benzthiazolyl, xanthene, thioxanthene, phenothiazine, dihydroindole, benzo[1,3]dioxole, benzo[b]furyl, benzo[b]thiophenyl, indazolyl, benzimidazolyl, benzthiazolyl, puryl, cinnolyl, quinolyl, quinazolyl, cinnolyl, phthalazyl, quinazolyl, quinoxalyl, isoquinolyl, 4H-quinolizyl, benzo-1,2,5-thiadiazolyl, or 1,8-naphthyridyl.

Without limitation, monocyclic heteroaryls include furyl, thiophenyl, 2H-pyrrolyl, pyrrolyl, oxazolyl, thazolyl, imidazolyl, pyrazolyl, isoxazolyl, isothiazolyl, 1,3,4-thiadiazolyl, 2H-pyranyl, 4-H-pranyl, pyridyl, pyridazyl, pyrimidyl, pyrazolyl, pyrazyl, or 1,3,5-triazyl. Monocyclic heteroaryls are numbered according to standard chemical nomenclature.

Without limitation, bicyclic heteroaryls include indolizyl, indolyl, isoindolyl, 3H-indolyl, indolinyl, benzo[b]furyl, benzo[b]thiophenyl, quinolinyl, isoquinolinyl, indazolyl, benzimidazyl, benzthiazolyl, purinyl, 4H-quinolizyl, quinolyl, isoquinolyl, cinnolyl, phthalazyl, quinazolyl, quinoxalyl, 1,8-naphthyridyl, or pteridyl. Bicyclic heteroaryls are numbered according to standard chemical nomenclature.

A heteroaryl is optionally substituted with one or more substituents such as aliphatic [e.g., alkyl, alkenyl, or alkynyl]; cycloaliphatic; (cycloaliphatic)aliphatic; heterocycloaliphatic; (heterocycloaliphatic)aliphatic; aryl; heteroaryl; alkoxy; (cycloaliphatic)oxy; (heterocycloaliphatic) oxy; aryloxy; heteroaryloxy; (araliphatic)oxy; (heteroaraliphatic)oxy; aroyl; heteroaroyl; amino; oxo (on a non-aromatic carbocyclic or heterocyclic ring of a bicyclic or tricyclic heteroaryl); nitro; carboxy; amido; acyl [e.g., aliphaticcarbonyl; (cycloaliphatic)carbonyl; ((cycloaliphatic)

aliphatic)carbonyl; (araliphatic)carbonyl; (heterocycloaliphatic)carbonyl; ((heterocycloaliphatic) aliphatic) carbonyl; and (heteroaraliphatic)carbonyl]; sulfonyl [e.g., aliphaticsulfonyl and aminosulfonyl]; sulfinyl [e.g., aliphaticsulfinyl]; sulfanyl [e.g., aliphaticsulfanyl]; nitro; cyano; halo; hydroxyl; mercapto; sulfoxy; urea; thiourea; sulfamoyl; sulfamide; or carbamoyl. Alternatively, a heteroaryl can be unsubstituted.

Non-limiting examples of substituted heteroaryls include (halo)heteroaryl [e.g., mono- and di-(halo)heteroaryl]; (carboxy)heteroaryl [e.g., (alkoxycarbonyl)heteroaryl]; cyanoheteroaryl; aminoheteroaryl [e.g., ((alkylsulfonyl)amino)heteroaryl and ((dialkyl)amino)heteroaryl]; (amido)heteroaryl [e.g., aminocarbonylheteroaryl, ((alkylcarbonyl)amino)heteroaryl, (((alkyl)amino)alkyl)aminocarbonyl)heteroaryl, (((heteroaryl)amino)carbonyl)heteroaryl, ((heterocycloaliphatic)carbonyl)heteroaryl, and ((alkylcarbonyl)amino)heteroaryl]; (cyanoalkyl)heteroaryl; (alkoxy)heteroaryl; (sulfamoyl)heteroaryl [e.g., (aminosulfonyl)heteroaryl]; (sulfonyl)heteroaryl [e.g., (alkylsulfonyl)heteroaryl]; (hydroxyalkyl)heteroaryl; (alkoxyalkyl)heteroaryl; (hydroxyl)heteroaryl; ((carboxy)alkyl) heteroaryl; [((dialkyl)amino)alkyl]heteroaryl; (heterocycloaliphatic)heteroaryl; (cycloaliphatic)heteroaryl; (nitroalkyl)heteroaryl; (((alkylsulfonyl)amino)alkyl)heteroaryl; ((alkylsulfonyl)alkyl)heteroaryl; (cyanoalkyl)heteroaryl; (acyl)heteroaryl [e.g., (alkylcarbonyl)heteroaryl]; (alkyl)heteroaryl, and (haloalkyl)heteroaryl [e.g., trihaloalkylheteroaryl].

A "heteroaliphatic (such as a heteroalkyl group) as used herein, refers to an aliphatic group (e.g., a $C_{1-4}$ alkyl group) that is substituted with a heteroaryl group. "Aliphatic," "alkyl," and "heteroaryl" have been defined above.

As used herein, an "acyl" group refers to a formyl group or $R^X$—C(O)— (such as -alkyl-C(O)—, also referred to as "alkylcarbonyl") where $R^X$ and "alkyl" have been defined previously. Acetyl and pivaloyl are examples of acyl groups.

As used herein, an "alkoxy" group refers to an alkyl-O— group where "alkyl" has been defined previously.

As used herein, a "carbamoyl" group refers to a group having the structure —O—CO—NR$^X$R$^Y$ or —NR$^X$—CO—O—R$^Z$ wherein R$^X$ and R$^Y$ have been defined above and R$^Z$ can be aliphatic, aryl, araliphatic, heterocycloaliphatic, heteroaryl, or heteroaraliphatic.

As used herein, a "carboxy" group refers to —COOH, —COOR$^X$, —OC(O)H, —OC(O)R$^X$ when used as a terminal group or —OC(O)— or —C(O)O—; when used as an internal group.

As used herein, a "haloaliphatic" group refers to an aliphatic group substituted with 1-3 halogen. For instance, the term haloalkyl includes the group —CF$_3$.

As used herein, a "mercapto" group refers to —SH.

As used herein, a "sulfo" group refers to —SO$_3$H or —SO$_3$R$^X$ when used terminally or —S(O)$_3$— when used internally.

As used herein, a "sulfamide" group refers to the structure —NR$^X$—S(O)$_2$—NR$^Y$R$^Z$ when used terminally and —NR$^X$—S(O)$_2$—NR$^Y$— when used internally, wherein R$^X$, R$^Y$, and R$^Z$ have been defined above.

As used herein, a "sulfamoyl" group refers to the structure —S(O)$_2$—NR$^X$R$^Y$ or —NR$^X$—S(O)$_2$—R$^Z$ when used terminally or —S(O)$_2$—NR$^X$— or —NR$^X$—S(O)$_2$— when used internally, wherein R$^X$, R$^Y$, and R$^Z$ are defined above.

As used herein a "sulfanyl" group refers to —S—R$^X$ when used terminally and —S— when used internally, wherein R$^X$ has been defined above. Examples of sulfanyls include alkylsulfanyl.

As used herein a "sulfinyl" group refers to —S(O)—R$^X$ when used terminally and —S(O)— when used internally, wherein R$^X$ has been defined above.

As used herein, a "sulfonyl" group refers to —S(O)$_2$—R$^X$ when used terminally and —S(O)$_2$— when used internally, wherein R$^X$ has been defined above.

As used herein, a "sulfoxy" group refers to —O—SO—R$^X$ or —SO—O—R$^X$, when used terminally and —O—S(O)— or —S(O)—O— when used internally, where R$^X$ has been defined above.

As used herein, a "halogen" or "halo" group refers to fluorine, chlorine, bromine or iodine.

As used herein, an "alkoxycarbonyl," which is encompassed by the term carboxy, used alone or in connection with another group refers to a group such as alkyl-O—C(O)—.

As used herein, an "alkoxyalkyl" refers to an alkyl group such as alkyl-O-alkyl-, wherein alkyl has been defined above.

As used herein, a "carbonyl" refers to —C(O)—.

As used herein, an "oxo" refers to =O.

As used herein, an "aminoalkyl" refers to the structure $(R^X)_2$N-alkyl-.

As used herein, a "cyanoalkyl" refers to the structure (NC)-alkyl-.

As used herein, a "urea" group refers to the structure —NR$^X$—CO—NR$^Y$R$^Z$ and a "thiourea" group refers to the structure —NR$^X$—CS—NR$^Y$R$^Z$ when used terminally and —NR$^X$—CO—NR$^Y$— or —NR$^X$—CS—NR$^Y$— when used internally, wherein R$^X$, R$^Y$, and R$^Z$ have been defined above.

As used herein, a "guanidino" group refers to the structure —N=C(N(R$^X$R$^Y$))N(R$^X$R$^Y$) wherein R$^X$ and R$^Y$ have been defined above.

As used herein, the term "amidino" group refers to the structure —C=(NR$^X$)N(R$^X$R$^Y$) wherein R$^X$ and R$^Y$ have been defined above.

The terms "terminally" and "internally" refer to the location of a group within a substituent. A group is terminal when the group is present at the end of the substituent not further bonded to the rest of the chemical structure. Carboxyalkyl, i.e., R$^X$O(O)C-alkyl is an example of a carboxy group used terminally. A group is internal when the group is present in the middle of a substituent to at the end of the substituent bound to the to the rest of the chemical structure. Alkylcarboxy (e.g., alkyl-C(O)O— or alkyl-OC(O)—) and alkylcarboxyaryl (e.g., alkyl-C(O)O-aryl- or alkyl-O(CO)-aryl-) are examples of carboxy groups used internally.

The phrase "optionally substituted" is used interchangeably with the phrase "substituted or unsubstituted." As described herein, compounds of the invention can optionally be substituted with one or more substituents, such as are illustrated generally above, or as exemplified by particular classes, subclasses, and species of the invention. As described herein, the variables contained herein encompass specific groups, such as alkyl and aryl. Unless otherwise noted, each of the specific groups for the variables contained herein can be optionally substituted with one or more substituents described herein. Each substituent of a specific group is further optionally substituted with one to three of halo, cyano, oxoalkoxy, hydroxyl, amino, nitro, aryl, haloalkyl, and alkyl. For instance, an alkyl group can be substituted with alkylsulfanyl and the alkylsulfanyl can be optionally substituted with one to three of halo, cyano, oxoalkoxy, hydroxyl, amino, nitro, aryl, haloalkyl, and alkyl. As an additional example, the cycloalkyl portion of a (cycloalkyl)carbonylamino can be optionally substituted with one to three of halo, cyano, alkoxy, hydroxyl, nitro, haloalkyl, and alkyl. When two alkoxy groups are bound to the same atom or adjacent atoms, the two alkoxy groups can form a ring together with the atom(s) to which they are bound.

In general, the term "substituted," whether preceded by the term "optionally" or not, refers to the replacement of hydrogen radicals in a given structure with the radical of a specified substituent. Specific substituents are described above in the definitions and below in the description of compounds and examples thereof. Unless otherwise indicated, an optionally substituted group can have a substituent at each substitutable position of the group, and when more than one position in any given structure can be substituted with more than one substituent selected from a specified group, the substituent can be either the same or different at every position. A ring substituent, such as a heterocycloalkyl, can be bound to another ring, such as a cycloalkyl, to form a spiro-bicyclic ring system, e.g., both rings share one common atom. As one of ordinary skill in the art will recognize, combinations of substituents envisioned by this invention are those combinations that result in the formation of stable or chemically feasible compounds.

The phrase "stable or chemically feasible," as used herein, refers to compounds that are not substantially altered when subjected to conditions to allow for their production, detection, and preferably their recovery, purification, and use for one or more of the purposes disclosed herein.

Unless otherwise stated, structures depicted herein are also meant to include all isomeric (e.g., enantiomeric, diastereomeric, and geometric (or conformational)) forms of the structure; for example, the R and S configurations for each asymmetric center, (Z) and (E) double bond isomers, and (Z) and (E) conformational isomers. Therefore, single stereochemical isomers as well as enantiomeric, diastereomeric, and geometric (or conformational) mixtures of the present compounds are within the scope of the invention. Unless otherwise stated, all tautomeric forms of the compounds of the invention are within the scope of the invention. Additionally, unless otherwise stated, structures depicted herein are also meant to include compounds that differ only in the presence of one or more isotopically enriched atoms. For example, compounds having the present structures except for the replacement of hydrogen by deuterium or tritium, or the replacement of a carbon by a $^{13}C$— or $^{14}C$-enriched carbon are within the scope of this invention. Such compounds are useful, for example, as analytical tools or probes in biological assays.

As used herein, Co-therapies include any oligonucleotide compounds that can be used alone or in combination with other cancer therapies to treat cancer.

II. Cancer Therapies

Cancer-therapies of the present invention include oligonucleotide compounds, chemotherapy agents, radiation therapy, surgery, or combinations thereof.

A. Oligonucleotide Compounds

1. Oncogene Targets

In some embodiments, the present invention provides antigene inhibitors of oncogenes. The present invention is not limited to the inhibition of a particular oncogene. Indeed, the present invention encompasses antigene inhibitors to any number of oncogenes including, but not limited to, those disclosed herein.

a. Ras

One gene which has captured the attention of many scientists is the human proto-oncogene, c-Ha-ras. This gene acts as a central dispatcher, relaying chemical signals into cells and controlling cell division. Ras gene alteration may cause the gene to stay in the "on" position. The ras oncogene is believed to underlie up to 30% of cancer, including colon cancer, lung cancer, bladder and mammary carcinoma (Bos, Cancer Res. 49:4682-4689 [1989]). The ras oncogene has therefore become a target for therapeutic drugs.

There are several reports showing that oligonucleotides complementary to various sites of ras mRNA can inhibit synthesis of ras protein (p21), which decreases the cell proliferation rate in cell culture (U.S. Pat. No. 5,576,208; U.S. Pat. No. 5,582,986; Daska et al., Oncogene Res. 5:267-275 [1990]; Brown et al., Oncogene Res. 4:243-252 [1989]; Saison-Behmoaras et al., EMBO J. 10:1111-1116 [1991]). Oligonucleotides complementary to the 5' flanking region of the c-Ha-ras RNA transcript have shown to inhibit tumor growth in nude mice for up to 14 days (Gray et al., Cancer Res. 53:577-580 [1993]). It was recently reported that an antisense oligonucleotide directed to a point mutation (G>C) in codon 12 of the c-Ha-ras mRNA inhibited cell proliferation as well as tumor growth in nude mice when it was injected subcutaneously (U.S. Pat. No. 5,576,208; U.S. Pat. No. 5,582,986; Schwab et al., Proc. Natl. Acad. Sci. USA 91:10460-10464 [1994]; each of which is herein incorporated by reference). Researchers have also reported that antisense drugs shrank ovarian tumors in small clinical trials (Roush et al., Science 276:1192-1194 [1997]).

b. her-2

The her-2 (also known as neu oncogene or erbB-2) oncogene encodes a receptor-like tyrosine kinase (RTK) that has been extensively investigated because of its role in several human carcinomas (Hynes and Stern, Biochim. et Biophy. Acta 1198:165-184 [1994]; Dougall et al., Oncogene 9:2109-2123 [1994]) and in mammalian development (Lee et al., Nature 378:394-398 [1995]). The sequence of the HER-2 protein was determined from a cDNA that was cloned by homology to the epidermal growth factor receptor (EGFR) mRNA from placenta (Coussens et al., Science 230:1132-1139 [1985]) and from a gastric carcinoma cell line (Yamamoto et al., Nature 319:230-234 [1986]). her-2 mRNA was shown to be about 4.5 kb (Coussens et al., Science 230:1132-1139 [1985]; Yamamoto et al., Nature 319:230-234 [1986]) and encodes a transmembrane glycoprotein of 185 kDa in normal and malignant human tissues (p185HER-2) (Hynes and Steen, Biochim. et Biophys. Acta 1198:165-184 [1994]; Dougall et al., Oncogene 9:2109-2123 [1994]). Overexpression of HER-2 causes phenotypic transformation of cultured cells (DiFiore et al., Science 237:178-182 [1987]; Hudziak et al., Proc. Natl. Acad. Sci. USA 84:7159-7163 [1987]) and has been associated with aggressive clinical progression of breast and ovarian cancer (Slamon et al., Science 235:177-182 [1987]; Slamon et al., Science 244:707-712 [1989]).

Her-2 is one of the most frequently altered genes in cancer. It encodes a transmembrane receptor (also known as p185) with tyrosine kinase activity and is a member of the epidermal growth factor (EGF) family, and thus is related to the epidermal growth factor receptor (EGFR or HER-1). Aberrant her-2 gene expression is present in a wide variety of cancers and is most common in breast, ovarian and gastric cancers. HER-2 is overexpressed in 25-30% of all human breast and ovarian cancers. Levels of HER-2 overexpression correlate well with clinical stage of breast cancer, prognosis and metastatic potential. Overexpression of HER-2 is associated with lower survival rates, increased relapse rates and increased metastatic potential. Tan et al., (Cancer Res., 57:1199 [1997]) have shown that overexpression of the HER-2 gene increases the metastatic potential of breast cancer cells without increasing their transformation ability.

Aberrant expression of HER-2 includes both increased expression of normal HER-2 and expression of mutant HER- 2. Activation of the her-2 proto-oncogene can occur by any of three mechanisms—point mutation, gene amplification and overexpression. Gene amplification is the most common mechanism. Unlike the other EGF family members for whom ligand activation is necessary for promoting transformation, overexpression of HER-2 alone is sufficient for transformation (Cohen, et al., J. Biol. Chem., 271:30897 [1996]).

Several therapeutic approaches have been used to reduce levels of the HER-2 gene product. The adenovirus type 5 gene product E1A has been studied as a potential therapeutic using a breast cancer model in nude mice. This gene product can repress HER-2/neu overexpression by repressing her-2/neu promoter activity, and suppress the tumorigenic potential of HER-2/neu-over-expressing ovarian cancer cells. In mice bearing HER-2/neu-overexpressing breast cancer xenografts, E1A delivered either by adenovirus or liposome significantly inhibited tumor growth and prolonged mouse survival compared with the controls (Chang et al., Oncogene 14:561 [1997])

Clinical trials have been conducted to evaluate a bispecific antibody which targets the extracellular domains of both the HER-2/neu protein product and Fc gamma RIII (CD16), the Fc gamma receptor expressed by human natural killer cells, neutrophils, and differentiated mononuclear phagocytes (Weiner et al., J. Hematotherapy, 4:471 [1995]).

Overexpression of HER-2 has also been found to be associated with increased resistance to chemotherapy. Thus, patients with elevated levels of HER-2 respond poorly to many drugs. Methods used to inhibit HER-2 expression have been combined with commonly used chemotherapeutic agents (Ueno et al., Oncogone 15:953 [1997]). Combining the adenovirus type 5 gene product, E1A, with Taxol™ showed a synergistic effect in human breast cancer cells. Zhang et al., (Oncogene, 12:571 [1996]) demonstrated that emodin, a tyrosine-specific inhibitor, sensitized non-small cell lung cancer (NSCLC) cells to a variety of chemotherapeutic drugs, including cisplatin, doxorubicin and etoposide. A HER-2 antibody was found to increase the efficacy of tamoxifen in human breast cancer cells (Witters et al., Breast Cancer Res. and Treatment, 42:1 [1997]).

Oligonucleotides have also been used to study the function of HER-2. A triplex-forming oligonucleotide targeted to the HER-2 promoter, 42 to 69 nucleotides upstream of the mRNA transcription start site was found to inhibit HER-2 expression in vitro (Ebbinghaus et al., J. Clin. Invest., 92:2433 [1993]). Porumb et al. (Cancer Res., 56:515 [1996]) also used a triplex-forming oligonucleotide targeted to the same HER-2 promoter region. Decreases in HER-2 mRNA and protein levels were seen in cultured cells. Juhl et al. (J. Biol. Chem., 272:29482 [1997]) used anti-HER-2 ribozymes targeted to a central region of the HER-2 RNA just downstream of the transmembrane region of the protein to demonstrate a reduction in HER-2 mRNA and protein levels in human ovarian cancer cells. A reduction in tumor growth in nude mice was also seen.

An antisense approach has been used as a potential therapeutic for HER-2 over-expressing cancers. Pegues et al. (Cancer Lett., 117:73 [1997]) cloned a 1.5 kb fragment of HER-2 in an antisense orientation into an expression vector; transfecting of this construct into ovarian cancer cells resulted in a reduction of anchorage-independent growth. Casalini et al. (Int. J. Cancer 72:631 [1997]) used several human HER-2 antisense vector constructs, containing HER-2 fragments from 151 bp to 415 bp in length, to demonstrate reduction in HER-2 protein levels and anchorage-independent growth in lung adenocarcinoma cells. Colomer et al. (Br. J. Cancer, 70:819 [1994]) showed that phosphodiester antisense oligonucleotides targeted at or immediately downstream of, the translation initiation codon inhibited proliferation of human breast cancer cells by up to 60%. Wiechen et al. (Int. J. Cancer 63:604 [1995]) demonstrated that an 18-nucleotide phosphorothioate oligonucleotide targeted to the coding region, 33 nucleotides downstream of the translation initiation codon, of HER-2 reduced anchorage-independent growth of ovarian cancer cells. Bertram et al. (Biochem. Biophys. Res. Commun., 200:661 [1994]) used antisense phosphorothioate oligonucleotides targeted to the translation initiation region and a sequence at the 3' part of the translated region of the mRNA which has high homology to a tyrosine kinase consensus sequence, and demonstrated a 75% reduction in HER-2 protein levels in human breast cancer cells. Liu et al., (Antisense and Nucleic Acid Drug Develop., 6:9 [1996]) used antisense phosphorothioate oligonucleotides targeted to the 5' cap site and coding region. The most effective oligonucleotide, targeted to the 5' cap site, reduced HER-2 protein expression by 90%. Cell proliferation was also reduced by a comparable amount. Vaughn et al. (Nuc. Acids. Res., 24:4558 [1996]) used phosphorothioate, phosphorodithioate and chimeric antisense oligonucleotides targeted at or adjacent to (either side) the translation initiation region of HER-2. An alternating dithioate/diester oligonucleotide targeted to the translation initiation region worked slightly better than an all phosphorothioate oligonucleotide. Brysch et al. (Cancer Gene Ther., 1: 99 [1994]) used chemically modified antisense oligonucleotides targeted to the translation initiation codon of HER-2 to reduce protein levels and cause growth arrest of human breast cancer cell line.

c. C-Myc

The c-myc gene product is encoded by an immediate early response gene, the expression of which can be induced by various mitogens. C-myc expression is involved in the signal transduction pathways leading to cell division. Studies have demonstrated that proliferating cells have higher levels of c-myc mRNA and c-myc protein than do quiescent cells. Antibodies directed against the human c-myc protein are known to inhibit DNA synthesis in nuclei isolated from human cells. Conversely, constitutive expression of c-myc produced by gene transfer inhibits induced differentiation of several cell lines. Constitutive expression of c-myc predisposes transgenic mice to the development of tumors.

Some studies have suggested that the c-myc gene product may play a proliferative role in SMCs. Balloon de-endothelialization and injury of rat aortas is known to increase c-myc mRNA expression of vascular SMC prior to their subsequent proliferation and migration. Also, SMCs in culture proliferate when exposed to several mitogens, including PDGF, FGF, EGF, IGF-1 and to serum. Each of these mitogens has been found to be capable of increasing the expression in other cell lines of either c-myc protein, c-myc mRNA, or both. Additionally, blood serum has been found to increase c-myc mRNA levels in SMCs.

Harel-Bellan et al. (J. Immun. 140; 2431-2435 (1988)) demonstrated that antisense oligonucleotides complementary to c-myc mRNA effectively inhibited the translation thereof in human T cells. These T cells were prevented from entering the S phase of cell division. c-myc proto-oncogene sequences are described in Marcu et al., Ann. Rev. Biochem., 61:809-860 [1992]; Watt et al., Nature, 303:725-728 [1983)]; Battey et al., Cell, 34:779-787 (1983); and Epstein et al, NTIS publication PB93-100576 d. Bcl2

In many types of human tumors, including lymphomas and leukemias, the human bcl-2 gene is overexpressed, and may be associated with tumorigenicity (Tsujimoto et al., Science 228:1440-1443 [1985]). High levels of expression of the human bcl-2 gene have been found in all lymphomas with t (14; 18) chromosomal translocations including most follicular B cell lymphomas and many large cell non-Hodgkin's lymphomas. High levels of expression of the bcl-2 gene have also been found in certain leukemias that do not have a t(14; 18) chromosomal translation, including most cases of chronic lymphocytic leukemia acute, many lymphocytic leukemias of the pre-B cell type, neuroblastomas, nasophryngeal carcinomas, and many adenocarcinomas of the prostate, breast and colon. (Reed et al., Cancer Res. 51:6529 [1991]; Yunis et al., New England J. Med. 320:1047; Campos et al., Blood 81:3091-3096 [1993]; McDonnell et al., Cancer Res. 52:6940-6944 [1992]; Lu et al., Int. J. Cancer 53:29-35 [1993]; Bonner et al., Lab Invest. 68:43 A [1993]).

e. TGF-α

Transforming Growth Factor Alpha (TGF-α) is a polypeptide of 50 amino acids. It was first isolated from a retrovirus-transformed mouse cell line and subsequently was identified in human tumor cells, in early rat embryo cells and in cell cultures from the human pituitary gland. TGF-α is closely related to Epidermal Growth Factor (EGF), both structurally and functionally, and both bind to the same receptor, i.e., Epidermal Growth Factor Receptor (EGFR).

The sequence and three dimensional structure of both EGF and TGF-α have been determined (Campbell et al., Prog. Growth Factor Res. 1:13 [1989]). TGF-α is a 50 amino acid polypeptide having about 40% homology of residues with EGF. Both peptides are characterized by three well defined loops (denoted A, B and C) and have three intramolecular disulphide bonds.

Several growth factors, including TGF-α and EGF, are believed to exert their biological effects via interaction with the Epidermal Growth Factor Receptor (EGF Receptor). The EGF Receptor is a Type 1 receptor tyrosine kinase. The EGF Receptor and its ligands are of interest for their roles in normal physiological processes as well as in hyperproliferative and neoplastic diseases.

The in vivo precursor of TGF-α is a 160 amino acid residue membrane-bound protein (pro-TGF-.alpha.) that is cleaved to yield a soluble compound (Massague, J. Biol. Chem., 265: 21393-21396 [1990]). This cleavage removes an extracellular portion comprised of 50 amino acids with a molecular weight of 6 Kd and is considered to be an important regulatory event (Pandiella et al., Proc. Natl. Acad. Sci. USA, 88:1726-1730 [1990]) that can be stimulated by phorbol esters acting via protein kinase C (Pandiella et al., J. Biol. Chem., 266:5769-5773 [1991]).

Cultured human prostatic tumor lines contain elevated levels of TGF-α mRNA and proliferate in response to TGF-α (Wilding et al., The Prostate, 15:1-12 [1989]). TGF-α appears to have both autocrine and paracrine function, stimulating physiologic activities such as cell division and angiogenesis. When induced in transgenic mice, TGF-α produced epithelial hyperplasia and focal dysplastic changes that resembled carcinoma in situ (Sandgren et al., Cell, 61:1121-1135 [1990]).

f. c-ki-Ras

The c-Ki-ras (KRAS) oncogene is expressed ubiquitously. KRAS, with a length of more than 30 kb, is much larger than HRAS or NRAS. Although the 3 ras genes, HRAS, KRAS, and NRAS, have different genetic structures, all code for proteins of 189 amino acid residues, generically designated p21. These genes acquire malignant properties by single point mutations that affect the incorporation of the 12th or 61st amino acid residue of their respective p21. KRAS is involved in malignancy much more often than is HRAS. In a study of 96 human tumors or tumor cell lines in the NIH 3T3 transforming system, (Pulciani et al., Nature 300: 539 (1982) found a mutated HRAS locus only in T24 bladder cancer cells, whereas transforming KRAS genes were identified in 8 different carcinomas and sarcomas.

In a serous cystadenocarcinoma of the ovary, Feig et al. (Science 223: 698 (1984)) showed the presence of an activated KRAS oncogene not activated in normal cells of the same patient. The transforming gene product displayed an electrophoretic mobility in SDS-polyacrylamide gels that differed from the mobility of KRAS transforming proteins in other tumors. Thus, a previously undescribed mutation was responsible for activation of KRAS in this ovarian carcinoma. To study the role of oncogenes in lung cancer, Rodenhuis et al. (New Eng. J. Med. 317: 929 (1987)) used an assay based on oligonucleotide hybridization following an in vitro amplification step. Genomic DNA was examined from 39 tumor specimens obtained at thoracotomy. The KRAS gene was found to be activated by point mutations in codon 12 in 5 of 10 adenocarcinomas. Two of these tumors were less than 2 cm in size and had not metastasized. No HRAS; KRAS or NRAS mutations were observed in 15 squamous cell carcinomas, 10 large cell carcinomas, 1 carcinoid, 2 metastatic adenocarcinomas from primary tumors outside the lung and 1 small cell carcinoma. An approximately 20-fold amplification of the unmutated KRAS gene was observed in a tumor that proved to be a solitary lung metastasis of a rectal carcinoma. Yanez et al. (Oncogene 1:315 (1987)) found mutations in codon 12 of the KRAS gene in 4 of 16 colon cancers, 2 of 27 lung cancers and 1 of 8 breast cancers; no mutations were found at position 61. Of the 6 possible amino acid replacements in codon 12, all but one were represented in the 7 mutations identified.

g. Other Oncogene Targets

The present invention is not limited to the oncogenes described above. The methods of the present invention are suitable for use with any oncogene with a known promoter region. Exemplary oncogenes included, but are not limited to, BCR/ABL, ABL1/BCR, ABL, BCL1, CD24, CDK4, EGFR/ERBB-1, HSTF1, INT1/WNT1, INT2, MDM2, MET, MYB, MYC, MYCN, MYCL1, RAF1, NRAS, REL, AKT2, APC, BCL2-ALPHA, BCL2-BETA, BCL3, BCR, BRCA1, BRCA2, CBL, CCND1, CDKN1A, CDKN1C, CDKN1A, CDKN2B, CRK, CRK-II, CSF1R/FMS, DBL, DDOST, DCC, DPC4/SMAD4, E-CAD, E2F1/RBAP, ELK1, ELKS, EPH, EPHA1, E2F1, EPHA3, ERG, ETS1, ETS2, FER, FGR, FLI1/ERGB2, FOS, FPS/FES, FRA1, FRA2, FYN, HCK, HEK, HER3/ERBB-2, ERBB-3, HER4/ERBB-4, HST2, INK4A, INK4B, JUN, JUNB, JUND, KIP2, KIT, KRAS2A, KRAS2B, LCK, LYN, MAS, MAX, MCC, MLH1, MOS, MSH2, MYBA, MYBB, NF1, NF2, P53, PDGFB, PIM1, PTC, RB1, RET, ROS1, SKI, SRC1, TAL1, TGFBR2, THRA1, THRB, TIAM1, TRK, VAV, VHL, WAF1, WNT2, WT1, YES1, ALK/NPM1, AMI1, AXL, FMS, GIP, GLI, GSP, HOX11, HST, IL3, INT2, KS3, K-SAM, LBC, LMO-1, LMO-2, L-MYC, LYL1, LYT-10, MDM-2, MLH1, MLL, MLM, N-MYC, OST, PAX-5, PMS-1, PMS-2, PRAD-1, RAF, RHOM-1, RHOM-2, SIS, TAL2, TAN1, TIAM1, TSC2, TRK, TSC1, STK11, PTCH, MEN1, MEN2, P57/KIP2, PTEN, HPC1, ATM, XPA/XPG, BCL6, DEK, AKAP13, CDH1, BLM, EWSR1/FLI1, FES, FGF3, FGF4, FGF6, FANCA, FLI1/ERGB2, FOSL1, FOSL2, GLI, HRAS1, HRX/MLLT1, HRX/MLLT2, KRAS2, MADH4, MAS1, MCF2, MLLT1/MLL, MLLT2/HRX, MTG8/RUNX1, MYCLK1, MYH11/CBFB, NFKB2, NOTCH1, NPM1/ALK, NRG/REL, NTRK1, PBX1/TCF3, PML/RARA, PRCA1, RUNX1, RUNX1/CBFA2T1, SET, TCF3/

PBX1, TGFB1, TLX1, P53, WNT1, WNT2, WT1, αv-β3, PKCα, TNFα, Clusterin, Surviving, TGFβ, c-fos, c-SRC, and INT-1.

2. Non-Oncogene Targets

The present invention is not limited to the targeting of oncogenes. The methods and compositions of the present invention are useful for targeting any gene that it is desirable to down regulate its expression. For example, in some embodiments, the genes to be targeted include, but are not limited to, an immunoglobulin or antibody gene, a clotting factor gene, a protease, a pituitary hormone, a protease inhibitor, a growth factor, a somatomedian, a gonadotrophin, a chemotactin, a chemokine, a plasma protein, a plasma protease inhibitor, an interleukin, an interferon, a cytokine, a transcription factor, or a pathogen target (e.g., a viral gene, a bacterial gene, a microbial gene, a fungal gene).

Examples of specific genes include, but are not limited to, ADAMTS4, ADAMTS5, APOA1, APOE, APP, B2M, COX2, CRP, DDX25, DMC1, FKBP8, GH1, GHR, IAPP, IFNA1, IFNG, IL1, Il10, IL12, IL13, IL2, IL4, IL7, IL8, IPW, MAPK14, Mei1, MMP13, MYD88, NDN, PACE4, PRNP, PSEN1, PSEN2, RAD51, RAD51C, SAP, SNRPN, TLR4, TLR9, TTR, UBE3A, VLA-4, and PTP-1B, c-RAF, m-TOR, LDL, VLDL, ApoB-100, HDL, VEGF, rhPDGF-BB, NADs, ICAM-1, MUC1,2-dG, CTL, PSGL-1, E2F, NF-kB, HIF, and GCPRs.

In other embodiments and gene from a pathogen is targeted. Exemplary pathogens include, but are not limited to, Human Immunodeficiency virus, Hepatitis B virus, hepatitis C virus, hepatitis A virus, respiratory syncytial virus, pathogens involved in severe acute respiratory syndrome, west nile virus and food borne pathogens (e.g., *E. coli*).

3. Oligonucleotides

In some embodiments, the present invention provides antigene oligonucleotides for inhibiting the expression of oncogenes. Exemplary design and production strategies for antigenes are described below. The description below is not intended to limit the scope of antigene compounds suitable for use in the present invention and that other antigenes are within the scope of the present invention.

a. Regulatory Regions of the Oncogenes

The bcl-2 gene has two promoters designated P1 and P2. P1 from which most bcl-2 mRNA is transcribed is located approximately 1.4 kb upstream of the translation initiation site and P2 is 1.3 kb downstream of P1. (See Seto, M. et al. *EMBO J.* 7, 123-131 (1988).) P1 is GC-rich, lacks a TATA box, has many transcription start sites and includes seven consensus binding sites for the SP1 transcription factor. P2 includes a CCAAT box and a TATA box and has two different transcription initiation sites. There are multiple NF-κB recognition sites and an SV40 enhancer-like octamer motif within P2. (See Heckman, C. A., et al. *Oncogene* 21, 3898-3908 (2002).) (See SEQ ID NO:1254). Most human follicular lymphomas contain t(14; 18) chromosomal translocations that result from 3'-bcl-2 gene region breakpoints. (See. Tsujimoto, Y. et al. *Proc. Natl. Acad. Sci. U.S.A* 84, 1329-1331 (1987).) These translocations place bcl-2 expression under control of the immunoglobulin heavy chain (IgH) locus enhancer resulting in upregulation of BCL2 expression. Alternatively, there are 5'-bcl-2 breakpoint regions that result from fusions with either the IgH locus or two different immunoglobulin light chain (IgL) loci that are found in some DLCL lymphoma patient isolates. (See Yonetani, N. et al. *Jpn. J. Cancer Res.* 92, 933-940 (2001).) These 5'-bcl-2 breakpoints have been mapped in separate heterogeneous patient isolates to a region spanning 378 to 2312 bp upstream of the translation initiation site. (See SEQ ID NOs:1255-1266.) Regions around the breakpoints may be sequences that can be used for bcl-2 oligonucleotide design.

The upstream regions of TGF-α, c-ki-ras, c-myc, c-erb-2 (Her-2), and c-Ha-ras can also be investigated to find regions to which oligonucleotides could bind based on preferred design criteria.

b. Oligonucleotide Design

The oligonucleotides can include any oligomer that hybridizes to the upstream regions of the c-ki-ras, c-Ha-ras, c-myc, her-2, TGF-α, or bcl-2 gene. For the purposes of this invention, those upstream regions are defined as SEQ ID NO:1 (for her-2, or c-erb-2), SEQ ID NO:282 (for c-ki-ras), SEQ ID NO:462 (for c-Ha-ras), SEQ ID NO:936 (for c-myc), SEQ ID NO:1081 (for TGF-α) and SEQ ID NOs:1249 and 1254 (for bcl-2).

In some embodiments, oligonucleotides are designed based on preferred design criteria. Such oligonucleotides can then be tested for efficacy using the methods disclosed herein. For example, in some embodiments, the oligonucleotides are methylated on at least one, two or all of the CpG islands. In other embodiments, the oligonucleotides contain no methylation. The present invention is not limited to a particular mechanism. Indeed, an understanding of the mechanism is not necessary to practice the present invention. Nonetheless, it is contemplated that oligonucleotides in some embodiments are those that have at least a 50% GC content and at least two GC dinucleotides. Also, in some embodiments, the oligonucleotides do not self hybridize. In further embodiments, oligonucleotides are designed with at least 1 A or T to minimize self hybridization. In yet further embodiments, commercially available computer programs are used to survey oligonucleotides for the ability to self hybridize. In still other embodiments, oligonucleotides are at least 10, or 15 nucleotides and no more than 100 nucleotides in length. In further embodiments, oligonucleotides are 18-26 nucleotides in length. In additional embodiments, oligonucleotides comprise the universal protein binding sequences CGCCC and CGCG or the complements thereof.

In some embodiments, oligonucleotides hybridize to a promoter region of a gene upstream from the TATA box of the promoter. In further embodiments, oligonucleotides are designed to hybridize to regions of the promoter region of an oncogene known to be bound by proteins (e.g., transcription factors). In some embodiments, oligonucleotide compounds are not completely homologous to other regions of the human genome. The homology of the oligonucleotide compounds of the present invention to other regions of the genome can be determined using available search tools (e.g., BLAST, available at the Internet site of NCBI).

The present invention is not limited to the oligonucleotides described herein. Other suitable oligonucleotides may be identified (e.g., using the criteria described above or other criteria). Candidate oligonucleotides may be tested for efficacy using any suitable method. For example, candidate oligonucleotides can be evaluated for their ability to prevent cell proliferation at a variety of concentrations. In some embodiments, oligonucleotides inhibit gene expression or cell proliferation at a low concentration (e.g., less than 20 μM, or 10 μM in in vitro assays.).

c. Oligonucleotide Zones

In some embodiments, regions within the promoter region of an oncogene are further defined as regions for hybridization of oligonucleotides. In some embodiments, these regions are referred to as "hot zones."

In some embodiments, hot zones are defined based on oligonucleotide compounds that are demonstrated to be effective (see above section on oligonucleotides) and those that are contemplated to be effective based on the criteria for oligonucleotides described above. In some embodiments, hot zones encompass 10 bp upstream and downstream of each compound included in each hot zone and have at least one CG or more within an increment of 40 bp further upstream or downstream of each compound. In further embodiments, hot zones encompass a maximum of 100 bp upstream and downstream of each oligonucleotide compound included in the hot zone. In additional embodiments, hot zones are defined at beginning regions of each promoter. These hot zones are defined either based on effective sequence(s) or contemplated sequences and have a preferred maximum length of 200 bp. Based on the above described criteria, exemplary hot zones were designed. These hot zones are shown in Table 1.

TABLE 1

Exemplary Hot Zones

| Gene | Hot Zones |
| --- | --- |
| Bcl-2 | 679-720, 930-1050. 1070-1280. 1420-1760 |
| c-erbB-2 | 206-346, 384-437 |
| c-K-ras | 1-290, 433-659 |
| c-Ha-ras | 21-220, 233-866, 1417-1536, 1637-1728 |
| c-myc | 71-263, 299-770 |
| TGF-α | 1-90, 175-219, 264-370, 434-934, 968-1183 | d. Description

In one aspect, the oligonucleotides can be any oligomer that hybridizes under physiological conditions to the following sequences: SEQ ID NO: 1, SEQ ID NO: 282, SEQ ID NO:462, SEQ ID NO:936, SEQ ID NO:1081, SEQ ID NO:1249 or SEQ ID NO:1254. In another aspect, the oligonucleotides can be any oligomer that hybridizes under physiological conditions to exemplary hot zones in SEQ ID NO: 1, SEQ ID NO: 282, SEQ ID NO:462, SEQ ID NO:936, SEQ ID NO:1081 and SEQ ID NO:1249. Examples of oligomers include, without limitation, those oligomers listed in SEQ ID NOs 2-281, 283-461, 463-935, 937-1080, 1082-1248, 1250-1253 and 1267-1477 and the complements thereof. In another aspect, the oligonucleotides are SEQ ID NOs 2-22, 283-301, 463-503, 937-958, 1082-1109, 1250-1254 and 1270-1477 and the complements thereof. In an embodiment of these aspects, the oligonucleotides are from 15-35 base pairs in length.

For the bcl-2 gene, the oligomer can be any oligomer that hybridizes to SEQ ID NOs: 1249 or 1254. In another aspect, the oligomer can be any oligomer that hybridizes to nucleotides 500-2026, nucleotides 500-1525, nucleotides 800-1225, nucleotides 900-1125, nucleotides 950-1075 or nucleotides 970-1045 of SEQ ID NO: 1249 or the complement thereof.

In one embodiment, the oligomer can be SEQ ID NO: 1250, 1251, 1252, 1253, 1267-1477 or the complement thereof. In another embodiment, the oligomer can be SEQ ID NO: 1250, 1251, 1267, 1268, 1276, 1277, 1285, 1286 or the complement thereof. In yet another embodiment, the oligomer can be SEQ ID NOs 1250, 1251, 1289-1358 or the complements thereof. In still another embodiment the oligomer can be SEQ ID NO: 1250 or 1251.

In a further embodiment of these aspects, the oligomer has the sequence of the positive strand of the bcl-2 sequence, and thus, binds to the negative strand of the sequence.

In other aspects, the oligomers can include mixtures of bcl-2 oligonucleotides. For instance, the oligomer can include multiple oligonucleotides each of which hybridizes to different parts of SEQ ID NOs: 1249 and 1254. Oligomers can hybridize to overlapping regions on those sequences or the oligomers may hybridize to non-overlapping regions. In other embodiments, oligomers can be SEQ ID NOs: 1250, 1251, 1252, 1253, 1267-1477 or the complement thereof, wherein the mixture of bcl-2 oligomers comprises oligomers of at least 2 different sequences.

In other embodiments, the oligomer can include a mixture of oligomers, each of which hybridizes to a regulatory region of different genes. For instance, the oligomer can include a first oligomer that hybridizes to SEQ ID NO: 1249 or 1254 and second oligomer that hybridizes to a regulatory region of a second gene. In some embodiments, the oligomer includes an oligomer of SEQ ID NOs 1250-1254 and 1267-1477 or the complements thereof, and an oligomer that hybridizes to SEQ ID NO: 1, SEQ ID NO: 282, SEQ ID NO: 462, SEQ ID NO: 936, or SEQ ID NO: 1081 or the complement thereof. In other embodiments, the oligomer includes SEQ ID NO 1250 or 1251 or the complement thereof and an oligomer that hybridizes to SEQ ID NO: 1, SEQ ID NO: 282, SEQ ID NO: 462, SEQ ID NO: 936, or SEQ ID NO: 1081 or the complement thereof. In yet other embodiments, the oligomer includes SEQ ID NO: 1250 or 1251 or the complement thereof and any of SEQ ID NOs 2-281, 283-461, 463-935, 937-1080 and 1082-1248, or the complement thereof.

In some embodiments, the present invention provides oligonucleotide therapeutics that are methylated at specific sites. The present invention is not limited to a particular mechanism. Indeed, an understanding of the mechanism is not necessary to practice the present invention. Nonetheless, it is contemplated that one mechanism for the regulation of gene activity is methylation of cytosine residues in DNA. 5-methylcytosine (5-MeC) is the only naturally occurring modified base detected in DNA (Ehrlick et al., Science 212: 1350-1357 (1981)). Although not all genes are regulated by methylation, hypomethylation at specific sites or in specific regions in a number of genes is correlated with active transcription (Doerfler, Annu. Rev. Biochem. 52:93-124 [1984]; Christman, Curr. Top. Microbiol. Immunol. 108:49-78 [1988]; Cedar, Cell 34:5503-5513 [1988]). DNA methylation in vitro can prevent efficient transcription of genes in a cell-free system or transient expression of transfected genes. Methylation of C residues in some specific cis-regulatory regions can also block or enhance binding of transcriptional factors or repressors (Doerfler, supra; Christman, supra; Cedar, Cell 34:5503-5513 (1988); Tate et al., Curr. Opin. Genet. Dev. 3:225-231 [1993]; Christman et al., Virus Strategies, eds. Doerfler, W. & Bohm, P. (VCH, Weinheim, N.Y.) pp. 319-333 [1993]).

Disruption of normal patterns of DNA methylation has been linked to the development of cancer (Christman et al., Proc. Natl. Acad. Sci. USA 92:7347-7351 [1995]). The 5-MeC content of DNA from tumors and tumor derived cell lines is generally lower than normal tissues (Jones et al., Adv. Cancer Res 40:1-30 [1983]). Hypomethylation of specific oncogenes such as c-myc, c-Ki-ras and c-Ha-ras has been detected in a variety of human and animal tumors (Nambu et al., Jpn. J. Cancer (Gann) 78:696-704 [1987]; Feinberg et al., Biochem. Biophys. Res. Commun. 111:47-54 [1983]; Cheah et al., JNCI 73:1057-1063 [1984]; Bhave et al., Carcinogenesis (Lond) 9:343-348 [1988]. In one of the best studied examples of human tumor progression, it has been shown that hypomethylation of DNA is an early event in development of colon cancer (Goetz et al., Science 228:187-290 [1985]). Interference with methylation in vivo can lead to tumor formation. Feeding of methylation inhibitors such as L-methionine or 5-azacytodine or severe deficiency of 5-adenosine methionine through feeding of a diet depleted of lipotropes has been reported to induce formation of liver tumors in rats (Wainfan et al., Cancer Res. 52:2071s-2077s [1992]). Studies show that extreme lipotrope deficient diets can cause loss of methyl groups at specific sites in genes such as c-myc, ras and c-fos (Dizik et al., Carcinogenesis 12:1307-1312 [1991]). Hypomethylation occurs despite the presence of elevated levels of DNA MTase activity (Wainfan et al., Cancer Res. 49:4094-4097 [1989]). Genes required for sustained active proliferation become inactive as methylated during differentiation and tissue specific genes become hypomethylated and are active. Hypomethylation can then shift the balance between the two states. In some embodiments, the present invention thus takes advantage of this naturally occurring phenomena, to provide compositions and methods for site specific methylation of specific gene promoters, thereby preventing transcription and hence translation of certain genes. In other embodiments, the present invention provides methods and compositions for upregulating the expression of a gene of interest (e.g., a tumor suppressor gene) by altering the gene's methylation patterns.

The present invention is not limited to the use of methylated oligonucleotides. Indeed, the use of non-methylated oligonucleotides for the inhibition of gene expression is specifically contemplated by the present invention. Experiments conducted during the course of development of the present invention (See e.g., Example 8) demonstrated that an unmethylated oligonucleotide targeted toward Bcl-2 inhibited the growth of lymphoma cells to a level that was comparable to that of a methylated oligonucleotide.

4. Preparation and Formulation of Oligonucleotides

Any of the known methods of oligonucleotide synthesis can be used to prepare the modified oligonucleotides of the present invention. In some embodiments utilizing methylated oligonucleotides the nucleotide, dC is replaced by 5-methyl-dC where appropriate, as taught by the present invention. The modified or unmodified oligonucleotides of the present invention are most conveniently prepared by using any of the commercially available automated nucleic acid synthesizers. They can also be obtained from commercial sources that synthesize custom oligonucleotides pursuant to customer specifications.

While oligonucleotides are one form of compound, the present invention comprehends other oligomeric oligonucleotide compounds, including but not limited to oligonucleotide mimetics such as are described below. The oligonucleotide compounds in accordance with this invention typically comprise from about 18 to about 30 nucleobases (i.e., from about 18 to about 30 linked bases), although both longer and shorter sequences may find use with the present invention.

Specific examples of compounds useful with the present invention include oligonucleotides containing modified backbones or non-natural internucleoside linkages. As defined in this specification, oligonucleotides having modified backbones include those that retain a phosphorus atom in the backbone and those that do not have a phosphorus atom in the backbone. For the purposes of this specification, modified oligonucleotides that do not have a phosphorus atom in their internucleoside backbone can also be considered to be oligonucleosides.

Modified oligonucleotide backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms are also included.

In some embodiments the oligonucleotides have a phosphorothioate backbone having the following general structure.

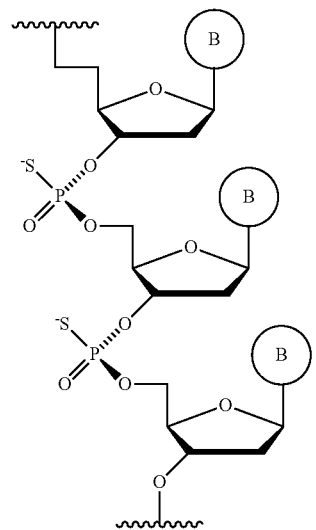

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

In other oligonucleotide mimetics, both the sugar and the internucleoside linkage (i.e., the backbone) of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone. Representative patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science 254:1497 (1991) and Neilsen, Methods in Enzymology, 313, 156-164 (1999). PNA compounds can be obtained commercially, for example, from Applied Biosystems (Foster City, Calif., USA).

In some embodiments, oligonucleotides of the invention are oligonucleotides with phosphorothioate backbones and oligonucleosides with heteroatom backbones, and in particular —$CH_2$, —NH—O—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$, and —O—N($CH_3$)—$CH_2$—$CH_2$— [wherein the native phosphodiester backbone is represented as —O—P—O—$CH_2$—] of the above referenced U.S. Pat. No. 5,489,677, and the amide backbones of the above referenced U.S. Pat. No. 5,602,240. Also exemplary are oligonucleotides having morpholino backbone structures of the above-referenced U.S. Pat. No. 5,034,506.

Oligonucleotides can also have sugars other than ribose and deoxy ribose, including arabinofuranose (described in International Publication number WO 99/67378, which is herein incorporated by reference), xyloarabinofuranose (described in U.S. Pat. Nos. 6,316,612 and 6,489,465, which are herein incorporated by reference), α-threofuranose (Schöning, et al. (2000) Science, 290, 1347-51, which is herein incorporated by reference) and L-ribofuranose. Sugar mimetics can replace the sugar in the nucleotides. They include cyclohexene (Wang et al. (2000) J. Am. Chem. Soc. 122, 8595-8602; Vebeure et al. Nucl. Acids Res. (2001) 29, 4941-4947, which are herein incorporated by reference), a tricyclo group (Steffens, et al. J. Am. Chem. Soc. (1997) 119, 11548-11549, which is herein incorporated by reference), a cyclobutyl group, a hexitol group (Maurinsh, et al. (1997) J. Org. Chem., 62, 2861-71; J. Am. Chem. Soc. (1998) 120, 5381-94, which are herein incorporated by reference), an altritol group (Allart, et al., Tetrahedron (1999) 6527-46, which is herein incorporated by reference), a pyrrolidine group (Scharer, et al., J. Am. Chem. Soc., 117, 6623-24, which is herein incorporated by reference), carbocyclic groups obtained by replacing the oxygen of the furnaose ring with a methylene group (Froehler and Ricca, J. Am. Chem. Soc. 114, 8230-32, which is herein incorporated by reference) or with an S to obtain 4'-thiofuranose (Hancock, et al., Nucl. Acids Res. 21, 3485-91, which is herein incorporated by reference), and/or morpholino group (Heasman, (2002) Dev. Biol., 243, 209-214, which is herein incorporated by reference) in place of the pentofuranosyl sugar. Morpholino oligonucleotides are commercially available from Gene Tools, LLC (Corvallis Oreg., USA).

The oligonucleotides can also include "locked nucleic acids" or LNAs. The LNAs can be bicyclic, tricyclic or polycyclic. LNAs include a number of different monomers, one of which is depicted in Formula I.

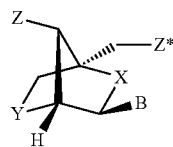

I wherein
B constitutes a nucleobase;
Z* is selected from an internucleoside linkage and a terminal group;
Z is selected from a bond to the internucleoside linkage of a preceding nucleotide/nucleoside and a terminal group, provided that only one of Z and Z* can be a terminal group;

X and Y are independently selected from —O—, —S—, —N(H)—, —N(R)—, —$CH_2$— or —C(H)=, $CH_2$—O—, —$CH_2$—S—, —$CH_2$—N(H)—, —$CH_2$—N(R)—, —$CH_2$—$CH_2$— or —$CH_2$—C(H)=, —CH=CH—;
provided that X and Y are not both O.

In addition to the LNA [2'-Y,4'-C-methylene-β-D-ribofuranosyl] monomers depicted in formula I (a [2,2,1]bicyclo nucleoside), an LNA nucleotide can also include "locked nucleic acids" with other furanose or other 5 or 6-membered rings and/or with a different monomer formulation, including 2'-Y,3' linked and 3'-Y,4' linked, 1'-Y,3 linked, 1'-Y,4' linked, 3'-Y,5' linked, 2'-Y, 5' linked, 1'-Y,2' linked bicyclonucleosides and others. All the above mentioned LNAs can be obtained with different chiral centers, resulting, for example, in LNA [3'-Y-4'-C-methylene (or ethylene)-β (or α)-arabino-, xylo- or L-ribo-furanosyl] monomers. LNA oligonucleotides and LNA nucleotides are generally described in International Publication No. WO 99/14226 and subsequent applications; International Publication Nos. WO 00/56746, WO 00/56748, WO 00/66604, WO 01/25248, WO 02/28875, WO 02/094250, WO 03/006475; U.S. Pat. Nos. 6,043,060, 6,268, 490, 6,770,748, 6,639,051, and U.S. Publication Nos. 2002/0125241, 2003/0105309, 2003/0125241, 2002/0147332, 2004/0244840 and 2005/0203042, all of which are incorporated herein by reference. LNA oligonucleotides and LNA analogue oligonucleotides are commercially available from, for example, Proligo LLC, 6200 Lookout Road, Boulder, Colo. 80301 USA.

Oligonucleotides can also contain one or more substituted sugar moieties. Oligonucleotides can comprise one of the following at the 2' sugar position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ allyl or $C_2$ to $C_{10}$ alkenyl and alkynyl, O[($CH_2$)$_n$O]$_m$$CH_3$, O($CH_2$)$_n$O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. Yet other oligonucleotides comprise one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide or a group improving pharmacodynamic properties of an oligonucleotide and other substituents having similar properties. One modification includes 2'-methoxyethoxy (2'-O—$CH_2CH_2OCH_3$, also known as 2'-O-(2-methoxyethyl) or 2'-MOE) (Martin et al., Helv. Chim. Acta 78:486 [1995]) i.e., an alkoxyalkoxy group. A further modification includes 2'-dimethylaminooxyethoxy (i.e., an O($CH_2$)$_2$ON($CH_3$)$_2$ group), also known as 2'-DMAOE, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_3$)$_2$.

Other modifications include 2'-methoxy (2'-O—$CH_3$), 2'-aminopropoxy(2'-O$CH_2CH_2CH_2NH_2$) and 2'-fluoro (2'-F). Similar modifications may also be made at other positions on the oligonucleotide, particularly the 3' position of the sugar on the 3' terminal nucleotide or in 2'-5' linked oligonucleotides and the 5' position of 5' terminal nucleotide. Oligonucleotides can also have sugar mimetics such as cyclobutyl moieties in place of the pentofuranosyl sugar.

Oligonucleotides may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine, isocytosine, pseudoisocytosine, 5-bromouracil, 5-propynyluracil, 5-propynylcytosine, 5-propyny-6-fluoroluracil, 5-methylthiazoleuracil, 6-aminopurine, 2-aminopurine, inosine, diaminopurine, 7-deazaguanine, 7-deazaadenine, 3-deazaguanine, 3-deazaadenine, 8-azaguanine, 8-azaadenine, 7-propyne-7-deazaadenine, 7-propyne-7-deazaguanine, 2-chloro-6-aminopurine, 4-acetylcytosine, 5-hydroxymethylcytosine, 8-hydroxy-N6-methyladenosine, aziridinylcytosine, 5-(carboxyhydroxyl-methyl) uracil, 5-fluorouracil, 5-carboxymethylaminomethyl-2-thiouracil, 5-carboxymethylaminomethyluracil, dihydrouracil, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, N6-methyladenine, 7-methylguanine and other alkyl derivatives of adenine and guanine, 2-propyl adenine and other alkyl derivatives of adenine and guanine, 2-aminoadenine, 5-methylaminomethyluracil, 5-methoxyaminomethyl-2-thiouracil, beta-D-mannosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 2-thiothymine, 5-halouracil, 5-halocytosine, 6-azo uracil, cytosine and thymine, 5-methyl-2-thiouracil, 2-thiouracil, 4-thiouracil, 5-methyluracil, 8-halo, 8-amino, 8-thiol, 8-hydroxyl and other 8-substituted adenines and guanines, 5-trifluoromethyl uracil and cytosine, N-uracil-5-oxyacetic acid methylester, uracil-5-oxyacetic acid, queosine, xanthine, hypoxanthine, 2-thiocytosine and 2,6-diaminopurine. Further nucleobases include those disclosed in U.S. Pat. No. 3,687,808. Certain of these nucleobases are particularly useful for increasing the binding affinity of the oligomeric compounds of the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by −0.6-1.2° C. These are particularly effective when combined with 2'-O-methoxyethyl sugar modifications.

Another modification of the oligonucleotides of the present invention involves chemically linking to the oligonucleotide one or more moieties or conjugates that enhance the activity, cellular distribution or cellular uptake of the oligonucleotide. Such moieties include but are not limited to lipid moieties such as a cholesterol moiety, cholic acid, a thioether, (e.g., hexyl-5-tritylthiol), a thiocholesterol, an aliphatic chain, (e.g., dodecandiol or undecyl residues), a phospholipid, (e.g., di-hexadecyl-rac-glycerol or triethylammonium 1,2-di-O-hexadecyl-rac-glycero-3-H-phosphonate), a polyamine or a polyethylene glycol chain or adamantane acetic acid, a palmityl moiety, or an octadecylamine or hexylamino-carbonyl-oxycholesterol moiety.

One skilled in the relevant art knows well how to generate oligonucleotides containing the above-described modifications. The present invention is not limited to the oligonucleotides described above. Any suitable modification or substitution may be utilized.

It is not necessary for all positions in a given compound to be uniformly modified, and in fact more than one of the aforementioned modifications may be incorporated in a single compound or even at a single nucleoside within an oligonucleotide. The present invention also includes pharmaceutical compositions and formulations that include the oligomeric compounds of the present invention as described below.

5. Cocktails

In some embodiments, the present invention provides cocktails comprising two or more oligonucleotides directed toward regulatory regions of genes (e.g., oncogenes). In some embodiments, two or more oligonucleotides hybridize to different regions of a regulatory region of the same gene. In other embodiments, the two or more oligonucleotides hybridize to regulatory regions of two different genes. The present invention is not limited to a particular mechanism. Indeed, an understanding of the mechanism is not necessary to practice the present invention. Nonetheless, it is contemplated that the combination of two or more compounds of the present invention provides an inhibition of cancer cell growth that is greater than the additive inhibition of each of the compounds administered separately.

6. Index of SEQ IDs

SEQ ID NO:1 c-erb-2 (her-2) upstream region
SEQ ID NOs:2-281 c-erb-2 (her-2) oligonucleotides
SEQ ID NO:282 c-ki-ras upstream region
SEQ ID NOs:283-461 c-ki-ras oligonucleotides
SEQ ID NO:462 c-Ha-ras upstream region
SEQ ID NOs:463-935 c-Ha-ras oligonucleotides
SEQ ID NO:936 c-myc upstream region
SEQ ID NOs:937-1080 c-myc oligonucleotides
SEQ ID NO:1081 TGF-α upstream region
SEQ ID NOs:1082-1248 TGF-α oligonucleotides
SEQ ID NO:1249 bcl-2 upstream region
SEQ ID NO:1250 PNT-100 oligonucleotide methylated
SEQ ID NO:1251 PNT-100 oligonucleotide not methylated
SEQ ID NO:1252 bcl-2 oligonucleotide methylated
SEQ ID NO:1253 bcl-2 oligonucleotide not methylated
SEQ ID NO:1254 bcl-2 secondary promoter sequence
SEQ ID NOs:1255-1266 bcl-2 sequences
SEQ ID NOs:1250-1254 bcl-2 oligonucleotides
and 1267-1477
SEQ ID NOs: 1448-1461 bcl-2 control oligonucleotides Oligonucleotide compounds of the present invention can be used alone or in combination with a chemotherapy agent, radiation therapy or surgery.

B. Chemotherapy Agents

Chemotherapy agents of the present invention can include any suitable chemotherapy drug or combinations of chemotherapy drugs (e.g., a cocktail). Exemplary chemotherapy agents include, without limitation, alkylating agents, platinums, anti-metabolites, anthracyclines, taxanes, camptothecins, nitrosoureas, EGFR inhibitors, antibiotics, HER2/neu inhibitors, angiogenesis inhibitors, kinase inhibitors, proteaosome inhibitors, immunotherapies, hormone therapies, photodynamic therapies, cancer vaccines, histone deacetylase inhibitors, sphingolipid modulators, oligomers, other unclassified chemotherapy drugs and combinations thereof.

1. Alkylating Agents

Alkylating agents are chemotherapy agents that are thought to attack the negatively charged sites on the DNA (e.g., the oxygen, nitrogen, phosphorous and sulfur atoms) and bind to the DNA thus altering replication, transcription and even base pairing. It is also believed that alkylation of the DNA also leads to DNA strand breaks and DNA strand cross-linking. By altering DNA in this manner, cellular activity is effectively stopped and the cancer cell will die. Common alkylating agents include, without limitation, procarbazine, ifosphamide, cyclophosphamide, melphalan, chlorambucil, decarbazine, busulfan, thiotepa, and the like. Alkylating agents such as those mentioned above can be used in combination with one or more other alkylating agents and/or with one or more chemotherapy agents of a different class(es).

2. Platinums

Platinum chemotherapy agents are believed to inhibit DNA synthesis, transcription and function by cross-linking DNA subunits. (The cross-linking can happen either between two strands or within one strand of DNA.) Common platinum chemotherapy agents include, without limitation, cisplatin, carboplatin, oxaliplatin, Eloxatin™, and the like. Platinum chemotherapy agents such as those mentioned above can be used in combination with one or more other platinums and/or with one or more chemotherapy agents of a different class (es).

3. Anti-Metabolites

Anti-metabolite chemotherapy agents are believed to interfere with normal metabolic pathways, including those necessary for making new DNA. Common anti-metabolites include, without limitation, Methotrexate, 5-fluorouracil (e.g., capecitabine), gemcitabine (2'-deoxy-2',2'-difluorocytidine monohydrochloride (β-isomer), Eli Lilly), 6-mercaptopurine, 6-thioguanine, fludarabine, cladribine, cytarabine, tegafur, raltitrexed, cytosine arabinoside, and the like. Gallium nitrate is another anti-metabolite that inhibits ribonucleotides reductase. Anti-metabolites such as those mentioned above can be used in combination with one or more other anti-metabolites and/or with one or more chemotherapy agents of a different class(es).

4. Anthracyclines

Anthracyclines are believed to promote the formation of free oxygen radicals. These radicals result in DNA strand breaks and subsequent inhibition of DNA synthesis and function. Anthracyclines are also thought to inhibit the enzyme topoisomerase by forming a complex with the enzyme and DNA. Common anthracyclines include, without limitation, daunorubicin, doxorubicin, idarubicin, epirubicin, mitoxantrone, adriamycin, bleomycin, mitomycin-C, dactinomycin, mithramycin and the like. Anthracyclines such as those mentioned above can be used in combination with one or more other anthracyclines and/or with one or more chemotherapy agents of a different class(es).

5. Taxanes

Taxanes are believed to bind with high affinity to the microtubules during the M phase of the cell cycle and inhibit their normal function. Common taxanes include, without limitation, paclitaxel, docetaxel, Taxotere™, Taxol™, taxasm, 7-epipaclitaxel, t-acetyl paclitaxel, 10-desacetyl-paclitaxel, 10-desacetyl-7-epipaclitaxel, 7-xylosylpaclitaxel, 10-desacetyl-7-epipaclitaxel, 7-N—N-dimethylglycylpaclitaxel, 7-L-alanylpaclitaxel and the like. Taxanes such as those mentioned above can be used in combination with one or more other taxanes and/or with one or more chemotherapy agents of a different class(es).

6. Camptothecins

Camptothecins are thought to complex with topoisomerase and DNA resulting in the inhibition and function of this enzyme. It is further believed that the presence of topoisomerase is required for on-going DNA synthesis. Common camptothecins include, without limitation, irinotecan, topotecan, etoposide, vinca alkaloids (e.g., vincristine, vinblastine or vinorelbine), amsacrine, teniposide and the like. Camptothecins such as those mentioned above can be used in combination with one or more other camptothecins and/or with one or more chemotherapy agents of a different class(es).

7. Nitrosoureas

Nitrosoureas are believed to inhibit changes necessary for DNA repair. Common nitrosoureas include, without limitation, carmustine (BCNU), lomustine (CCNU), semustine and the like. Nitrosoureas such as those mentioned above can be used in combination with one or more other nitrosoureas and/or with one or more chemotherapy agents of a different class(es).

8. EGFR Inhibitors

EGFR (i.e., epidermal growth factor receptor) inhibitors are thought to inhibit EGFR and interfere with cellular responses including cell proliferation and differentiation. EGFR inhibitors include molecules that inhibit the function or production of one or more EGFRs. They include small molecule inhibitors of EGFRs, antibodies to EGFRs, antisense oligomers, RNAi inhibitors and other oligomers that reduce the expression of EGFRs. Common EGFR inhibitors include, without limitation, gefitinib, erlotinib (Tarceva®), cetuximab (Erbitux™), panitumumab (Vectibix®, Amgen) lapatinib (GlaxoSmithKline), CI1033 or PD183805 or canternib (6-acrylamide-N-(3-chloro-4-fluororphenyl)-7-(3-morpholinopropoxy)quinazolin-4-amine, Pfizer), and the like. Other inhibitors include PKI-166 (4-[(1R)-1-phenylethylamino]-6-(4-hydroxyphenyl)-7 H-pyrrolo[2,3-d]pyrimidine, Novartis), CL-387785 ( N-[4-(3-bromoanilino)quinazolin-6-yl]but-2-ynamide), EKB-569 (4-(3-chloro-4-fluororanilino)-3-cyano-6-(4-dimethylaminobut2(E)-enamido)-7-ethoxyquinoline, Wyeth), lapatinib (GW2016, GlaxoSmithKline), EKB509 (Wyeth), panitumumab (ABX-EGF, Abgenix), matuzumab (EMD 72000, Merck), and the monoclonal antibody RH3 (New York Medical). EGFR inhibitors such as those mentioned above can be used in combination with one or more other EGFR inhibitors and/or with one or more chemotherapy agents of a different class(es).

9. Antibiotics

Antibiotics are thought to promote the formation of free oxygen radicals that result in DNA breaks leading to cancer cell death. Common antibiotics include, without limitation, bleomycin and rapamycin and the like. The macrolide fungicide rapamycin (also called RAP, rapamune and sirolimus) binds intracellularly to the to the immunophilin FK506 binding protein 12 (FKBP12) and the resultant complex inhibits the serine protein kinase activity of mammalian target of rapamycin (mTOR). Rapamycin macrolides include naturally occurring forms of rapamycin as well as rapamycin analogs and derivatives that target and inhibit mTOR. Other rapamycin macrolides include, without limitation, temsirolimus (CCI-779, Wyeth)), everolimus and ABT-578. Antibiotics such as those mentioned above can be used in combination with one or more other antibiotics and/or with one or more chemotherapy agents of a different class(es).

10. HER2/neu Inhibitors

HER2/neu Inhibitors are believed to block the HER2 receptor and prevent the cascade of reactions necessary for tumor survival. Her2 inhibitors include molecules that inhibit the function or production of Her2. They include small molecule inhibitors of Her2, antibodies to Her2, antisense oligomers, RNAi inhibitors and other oligomers that reduce the expression of tyrosine kinases. Common HER2/neu inhibitors include, without limitation, trastuzumab (Herceptin®, Genentech) and the like. Other Her2/neu inhibitors include bispecific antibodies MDX-210 (FCγR1-Her2/neu) and MDX-447 (Medarex), pertuzumab (rhuMAb 2C4, Genentech), HER2/neu inhibitors such as those mentioned above can be used in combination with one or more other HER2/neu inhibitors and/or with one or more chemotherapy agents of a different class(es).

11. Angiogenesis Inhibitors

Angiogenesis inhibitors are believed to inhibit vascular endothelial growth factor, i.e. VEGF, thereby inhibiting the formation of new blood vessels necessary for tumor life. VEGF inhibitors include molecules that inhibit the function or production of one or more VEGFs. They include small molecule inhibitors of VEGF, antibodies to VEGF, antisense oligomers, RNAi inhibitors and other oligomers that reduce the expression of tyrosine kinases. Common angiogenesis inhibitors include, without limitation, bevacizumab (Avastin®, Genentech). Other angiogenesis inhibitors include, without limitation, ZD6474 (AstraZeneca), BAY-43-9006, sorafenib (Nexavar®, Bayer), semaxanib (SU5416, Pharmacia), SU6668 (Pharmacia), ZD4190 (N-(4-bromo-2-fluorophenyl)-6-methoxy-7-[2-(1H-1,2,3-triazol-1-yl)ethoxy] quinazolin-4-amine, Astra Zeneca), Zactima™ (ZD6474, N-(4-bromo-2-fluorophenyl)-6-methoxy-7-[2-(1H-1,2,3-triazol-1-yl)ethoxy]quinazolin-4-amine, Astra Zeneca), vatalanib, (PTK787, Novartis), the monoclonal antibody IMC-1C11 (Imclone) and the like. Angiogenesis inhibitors such as those mentioned above can be used in combination with one or more other angiogenesis inhibitors and/or with one or more chemotherapy agents of a different class(es).

12. Other Kinase Inhibitors

In addition to EGFR, HER2 and VEGF inhibitors, other kinase inhibitors are used as chemotherapeutic agents. Aurora kinase inhibitors include, without limitation, compounds such as 4-(4-N benzoylamino)aniline)-6-methyxy-7-(3-(1-morpholino)propoxy)quinazoline (ZM447439, Ditchfield et al., J. Cell. Biol., 161:267-80 (2003)) and hesperadin (Haaf et al., J. Cell Biol., 161: 281-94 (2003)). Other compounds suitable for use as Aurora kinase inhibitors are described in Vankayalapati H, et al., Mol. Cancer. Ther. 2:283-9 (2003). SRC/Abl kinase inhibitors include without limitation, AZD0530 (4-(6-chloro-2,3-methylenedioxyanilino)-7-[2-(4-methylpiperazin-1-ypethoxy]-5-tetrahycropyran-4-yloxyquinazoline). Tyrosine kinase inhibitors include molecules that inhibit the function or production of one or more tyrosine kinases. They include small molecule inhibitors of tyrosine kinases, antibodies to tyrosine kinases and antisense oligomers, RNAi inhibitors and other oligomers that reduce the expression of tyrosine kinases. CEP-701 and CEP-751 (Cephalon) act as tyrosine kinase inhibitors. Imatinib mesylate is a tyrosine kinase inhibitor that inhibits bcr-abl by binding to the ATP binding site of bcr-abl and competitively inhibiting the enzyme activity of the protein. Although imatinib is quite selective for bcr-abl, it does also inhibit other targets such as c-kit and PDGF-R. FLT-3 inhibitors include, without limitation, tandutinib (MLN518, Millenium), sutent (SU11248, 5-[5-fluoro-2-oxo-1,2-dihydroindol-(3Z)-ylidenemethyl]-2,4-dimethyl-1H-pyrrole-3-carboxylic acid [2-diethylaminoethyl]amide, Pfizer), midostaurin (4'-N-benzoyl staurosporine, Novartis), lefunomide (SU101) and the like. MEK inhibitors include, without limitation, 2-(2-Chloro-4-iodo-phenylamino)-N-cyclopropylmethoxy-3,4-difluoro-benzamide) (PD184352/CI-1044, Pfizer), PD198306 (Pfizer), PD98059 (2'-amino-3'-methoxy-flavone), U0126 (Promega), Ro092-210 from fermented microbial extracts (Roche), the resorcyclic acid lactone, L783277, also isolated from microbial extracts (Merck) and the like. Tyrosine kinase inhibitors such as those mentioned above can be used in combination with one or more other tyrosine kinase inhibitors and/or with one or more chemotherapy agents of a different class(es).

13. Proteaosome Inhibitors

Proteaosome inhibitors are believed to inhibit the breakdown of some of these proteins that have been marked for destruction. This results in growth arrest or death of the cell. Common proteaosome inhibitors include, without limitation, bortezomib, ortezomib and the like. Proteaosome inhibitors such as those mentioned above can be used in combination with one or more other proteaosome inhibitors and/or with one or more chemotherapy agents of a different class(es).

14. Immunotherapies

Immunotherapies are thought to bind to and block specific targets, thereby disrupting the chain of events needed for tumor cell proliferation. Common immunotherapies include, without limitation, rituximab and other antibodies directed against CD20, Campath-1H™ and other antibodies directed against CD-50, epratuzmab and other antibodies directed against CD-22, galiximab and other antibodies directed against CD-80, apolizumab HU1D10 and other antibodies directed against HLA-DR, and the like. Radioisotopes can be conjugated to the antibody, resulting in radioimmunotherapy. Two such anti-CD20 products are tositumomab (Bexxar™) and ibritumomab (Zevalin™) Immunotherapies such as those mentioned above can be used in combination with one or more other immunotherapies and/or with one or more chemotherapy agents of a different class(es).

15. Hormone Therapies

Hormone therapies are thought to block cellular receptors, inhibit the in vivo production of hormones, and/or eliminate or modify hormone receptors on cells, all with the end result of slowing or stopping tumor proliferation. Common hormone therapies include, without limitation, antiestrogens (e.g., tamoxifen, toremifene, fulvestrant, raloxifene, droloxifene, idoxifene and the like), progestogens) e.g., megestrol acetate and the like) aromatase inhibitors (e.g., anastrozole, letrozole, exemestane, vorozole, exemestane, fadrozole, aminoglutethimide, exemestane, 1-methyl-1,4-androstadiene-3, 17-dione and the like), anti-androgens (e.g., bicalutimide, nilutamide, flutamide, cyproterone acetate, and the like), luteinizing hormone releasing hormone agonist (LHRH Agonist) (e.g., goserelin, leuprolide, buserelin and the like); 5-α-reductase inhibitors such as finasteride, and the like. Hormone therapies such as those mentioned above can be used in combination with one or more other hormone therapies and/or with one or more chemotherapy agents of a different class (es).

16. Photodynamic Therapies

Photodynamic therapies expose a photosensitizing drug to specific wavelengths of light to kill cancer cells. Common photodynamic therapies include, for example, porfimer sodium (e.g., Photofrine) and the like. Photodynamic therapies such as those mentioned above can be used in combination with one or more other photodynamic therapies and/or with one or more chemotherapy agents of a different class (es).

17. Cancer Vaccines

Cancer vaccines are thought to utilize whole, inactivated tumor cells, whole proteins, peptide fragments, viral vectors and the like to generate an immune response that targets cancer cells. Common cancer vaccines include, without limitation, modified tumor cells, peptide vaccine, dendritic vaccines, viral vector vaccines, heat shock protein vaccines and the like.

18. Histone Deacetylase Inhibitors

Histone deacetylase inhibitors are able to modulate transcriptional activity and consequently, can block angiogenesis and cell cycling, and promote apoptosis and differentiation. Histone deacetylase inhibitors include, without limitation, SAHA (suberoylanilide hydroxamic acid), depsipeptide (FK288) and analogs, Pivanex™ (Titan), CI994 (Pfizer), MS275 PXD101 (CuraGen, TopoTarget) MGCD0103 (MethylGene), LBH589, NVP-LAQ824 (Novartis) and the like and have been used as chemotherapy agents. Histone deacetylase inhibitors such as those mentioned above can be used in combination with one or more other histone deacetylase inhibitors and/or with one or more chemotherapy agents of a different class(es).

19. Sphingolipid Modulators

Modulators of Sphingolipid metabolism have been shown to induce apoptosis. For reviews see N. S. Raclin, Biochem J, 371:243-56 (2003); D. E. Modrak, et al., Mol. Cancer. Ther, 5:200-208 (2006), K. Desai, et al., Biochim Biophys Acta, 1585:188-92 (2002) and C. P. Reynolds, et al. and Cancer Lett, 206, 169-80 (2004), all of which are incorporated herein by reference. Modulators and inhibitors of various enzymes involved in sphingolipid metabolism can be used as chemotherapeutic agents.

(a) Ceramide has been shown to induce apoptosis, consequently, exogenous ceramide or a short chain ceramide analog such as N-acetylsphingosine ($C_2$-Cer), $C_6$-Cer or $C_8$-Cer has been used. Other analogs include, without limitation, Cer 1-glucuronide, poly(ethylene glycol)-derivatized ceramides and pegylated ceramides.

(b) Modulators that stimulate ceramide synthesis have been used to increase ceramide levels. Compounds that stimulate serine palmitoyltransferase, an enzyme involved in ceramide synthesis, include, without limitation, tetrahydrocannabinol (THC) and synthetic analogs and anandamide, a naturally occurring mammalian cannabinoid. Gemcitabine, retinoic acid and a derivative, fenretinide [N-(4-hydroxyphenyl)retinamide, (4-HPR)], camptothecin, homocamptothecin, etoposide, paclitaxel, daunorubicin and fludarabine have also been shown to increase ceramide levels. In addition, valspodar (PSC833, Novartis), a non-immunosuppressive non-ephrotoxic analog of cyclosporin and an inhibitor of p-glycoprotein, increases ceramide levels.

(c) Modulators of sphingomyelinases can increase ceramide levels. They include compounds that lower GSH levels, as GSH inhibits sphingomyelinases. For example, betathine (β-alanyl cysteamine disulphide), oxidizes GSH, and has produced good effects in patients with myeloma, melanoma and breast cancer. COX-2 inhibitors, such as celecoxib, ketoconazole, an antifungal agent, doxorubicin, mitoxantrone, D609 (tricyclodecan-9-yl-xanthogenate), dexamethasone, and Ara-C (1-β-D-arabinofuranosylcytosine) also stimulate sphingomyelinases.

(d) Molecules that stimulate the hydrolysis of glucosylceramide also raise ceramide levels. The enzyme, GlcCer glucosidase, which is available for use in Gaucher's disease, particularly with retinol or pentanol as glucose acceptors and/or an activator of the enzyme can be used as therapeutic agents. Saposin C and analogs thereof, as well as analogs of the anti-psychotic drug, chloropromazine, may also be useful.

(e) Inhibitors of glucosylceramide synthesis include, without limitation, PDMP (N-[2-hydroxy-1-(4-morpholinylmethyl)-2-phenylethyldecanamide]), PMPP (D,L-threo-(1-phenyl-2-hexadecanoylamino-3-morpholino-1-propanol), P4 or PPPP (D-threo-1-phenyl-2-palmitoylamino-3-pyrrolidino-1-propanol), ethylenedioxy-P4,2-decanoylamine-3-morpholinoprophenone, tamixofen, raloxifene, mifepristone (RU486), N-butyl deoxynojirimycin and anti-androgen chemotherapy (bicalutamide+leuprolide acetate). Zavesca®, (1,5-(butylimino)-1,5-dideoxy-D-glucitol) usually used to treat Gaucher's disease, is another inhibitor of glucosylceramide synthesis.

(f) Inhibitors of ceramidase include, without limitation, N-oleoylethanolamine, a truncated form of ceramide, D-MAPP (D-erythro-2-tetradecanoylamino-1-phenyl-1-propanol) and the related inhibitor B13 (p-nitro-D-MAPP).

(g) Inhibitors of sphingosine kinase also result in increased levels of ceramide. Inhibitors include, without limitation, safingol (L-threo-dihydrosphingosine), N,N-dimethyl sphingosine, trimethyl sphingosine and analogs and derivatives of sphingosine such as dihydrosphingosine, and myriocin.

(h) Fumonisins and fumonisin analogs, although they inhibit ceramide synthase, also increase levels of sphinganine due to the inhibition of de novo sphingolipid biosynthesis, resulting in apoptosis.

(i) Other molecules that increase ceramide levels include, without limitation, miltefosine (hexadecylphosphocholine). Sphingolipid modulators, such as those mentioned above, can be used in combination with one or more other sphingolipid modulators and/or with one or more chemotherapy agents of a different class(es).

20. Oligomers

In addition to the oligonucleotides of the present invention, other oligonucleotides have been used as cancer therapies. They include Genasense® (oblimersen, G3139, from Genta), an antisense oligonucleotide that targets bcl-2 and G4460 (LR3001, from Genta) another antisense oligonucleotide that targets c-myb. Other oligomers include, without limitation, siRNAs, decoys, RNAi oligonucleotides and the like. Oligonucleotides, such as those mentioned above, can be used in combination with one or more other oligonucleotide inhibitors and/or with one or more chemotherapy agents of a different class(es).

21. Other Chemotherapy Drugs

Additional unclassified chemotherapy agents are described in Table 2 below.

TABLE 2

Additional unclassified chemotherapy agents.

| Generic Name | Brand Name | Manufacturer |
| --- | --- | --- |
| aldesleukin (des-alanyl-1, serine-125 human interleukin-2) | Proleukin ™ | Chiron Corp., Emeryville, CA |
| alemtuzumab (IgG1κ anti CD52 antibody) | Campath ™ | Millennium and ILEX Partners, LP, Cambridge, MA |
| alitretinoin (9-cis-retinoic acid) | Panretin ™ | Ligand Pharmaceuticals, Inc., San Diego CA |
| allopurinol (1,5-dihydro-4H-pyrazolo[3,4-d]pyrimidin-4-one monosodium salt) | Zyloprim ™ | GlaxoSmithKline, Research Triangle Park, NC |
| altretamine (N,N,N',N',N'',N'',-hexamethyl-1,3,5-triazine- | Hexalen ™ | US Bioscience, West |

TABLE 2-continued

Additional unclassified chemotherapy agents.

| Generic Name | Brand Name | Manufacturer |
|---|---|---|
| 2,4,6-triamine) | | Conshohocken, PA |
| amifostine (ethanethiol, 2-[(3-aminopropyl)amino]-, dihydrogen phosphate (ester)) | Ethyol ™ | US Bioscience |
| anastrozole (1,3-Benzenediacetonitrile, a,a,a',a'-tetramethyl-5-(1H-1,2,4-triazol-1-ylmethyl)) | Arimidex ™ | AstraZeneca Pharmaceuticals, LP, Wilmington, DE |
| arsenic trioxide | Trisenox ™ | Cell Therapeutic, Inc., Seattle, WA |
| asparaginase (L-asparagine amidohydrolase, type EC-2) | Elspar ™ | Merck & Co., Inc., Whitehouse Station, NJ |
| BCG Live (lyophilized preparation of an attenuated strain of *Mycobacterium bovis* (*Bacillus Calmette-Gukin* [BCG], substrain Montreal) | TICE BCG ™ | Organon Teknika, Corp., Durham, NC |
| bexarotene capsules (4-[1-(5,6,7,8-tetrahydro-3,5,5,8,8-pentamethyl-2-napthalenyl) ethenyl] benzoic acid) | Targretin ™ | Ligand Pharmaceuticals |
| bexarotene gel | Targretin ™ | Ligand Pharmaceuticals |
| carmustine with polifeprosan 20 implant | Gliadel Wafer ™ | Guilford Pharmaceuticals, Inc., Baltimore, MD |
| celecoxib (as 4-[5-(4-methylphenyl)-3-(trifluoromethyl)-1H-pyrazol-1-yl] benzenesulfonamide) | Celebrex ™ | Searle Pharmaceuticals, England |
| chlorambucil (4-[bis(2chlorethyl)amino]benzenebutanoic acid) | Leukeran ™ | GlaxoSmithKline |
| cladribine (2-chloro-2'-deoxy-b-D-adenosine) | Leustatin, 2-CdA ™ | R.W. Johnson Pharmaceutical Research Institute, Raritan, NJ |
| dacarbazine (5-(3,3-dimethyl-1-triazeno)-imidazole-4-carboxamide (DTIC)) | DTIC-Dome ™ | Bayer AG, Leverkusen, Germany |
| dactinomycin, actinomycin D (actinomycin produced by *Streptomyces parvullus*, $C_{62}H_{86}N_{12}O_{16}$) | Cosmegen ™ | Merck |
| darbepoetin alfa (recombinant peptide) | Aranesp ™ | Amgen, Inc., Thousand Oaks, CA |
| denileukin diftitox (recombinant peptide) | Ontak ™ | Seragen, Inc., Hopkinton, MA |
| dexrazoxane ((S)-4,4'-(1-methyl-1,2-ethanediyl)bis-2,6-piperazinedione) | Zinecard ™ | Pharmacia & Upjohn Company |
| dromostanolone propionate (17b-Hydroxy-2a-methyl-5a-androstan-3-one propionate) | Dromostanolone ™ | Eli Lilly & Company, Indianapolis, IN |
| dromostanolone propionate | Masterone injection ™ | Syntex, Corp., Palo Alto, CA |
| Elliott's B Solution | Elliott's B Solution ™ | Orphan Medical, Inc |
| epoetin alfa (recombinant peptide) | Epogen ™ | Amgen, Inc |
| estramustine (estra-1,3,5(10)-triene-3,17-diol(17(beta))-, 3-[bis(2-chloroethyl)carbamate] 17-(dihydrogen phosphate), disodium salt, monohydrate, or estradiol 3-[bis(2-chloroethyl)carbamate] 17-(dihydrogen phosphate), disodium salt, monohydrate) | Emcyt ™ | Pharmacia & Upjohn Company |
| exemestane (6-methylenandrosta-1,4-diene-3,17-dione) | Aromasin ™ | Pharmacia & Upjohn Company |
| filgrastim (r-metHuG-CSF) | Neupogen ™ | Amgen, Inc |
| floxuridine (intraarterial) (2'-deoxy-5-fluorouridine) | FUDR ™ | Roche |
| fulvestrant (7-alpha-[9-(4,4,5,5,5-penta fluoropentylsulphinyl) nonyl]estra-1,3,5-(10)-triene-3,17-beta-diol) | Faslodex ™ | IPR Pharmaceuticals, Guayama, Puerto Rico |

TABLE 2-continued

Additional unclassified chemotherapy agents.

| Generic Name | Brand Name | Manufacturer |
|---|---|---|
| gemtuzumab ozogamicin (anti-CD33 hP67.6) | Mylotarg ™ | Wyeth Ayerst |
| hydroxyurea | Hydrea ™ | Bristol-Myers Squibb |
| ifosfamide (3-(2-chloroethyl)-2-[(2-chloroethyl)amino]tetrahydro-2H-1,3,2-oxazaphosphorine 2-oxide) | IFEX ™ | Bristol-Myers Squibb |
| imatinib mesilate (4-[(4-Methyl-1-piperazinyl)methyl]-N-[4-methyl-3-[[4-(3-pyridinyl)-2-pyrimidinyl]amino]-phenyl]benzamide methanesulfonate) | Gleevec ™ | Novartis AG, Basel, Switzerland |
| interferon alpha-2a (recombinant peptide) | Roferon-A ™ | Hoffmann-La Roche, Inc., Nutley, NJ |
| interferon alpha-2b (recombinant peptide) | Intron A ™ (Lyophilized Betaseron) | Schering AG, Berlin, Germany |
| irinotecan HCl ((4S)-4,11-diethyl-4-hydroxy-9-[(4-piperidinopiperidino)carbonyloxy]-1H-pyrano[3',4': 6,7] indolizino[1,2-b] quinoline-3,14(4H,12H) dione hydrochloride trihydrate) | Camptosar ™ | Pharmacia & Upjohn Company |
| letrozole (4,4'-(1H-1,2,4-Triazol-1-ylmethylene) dibenzonitrile) | Femara ™ | Novartis |
| leucovorin (L-Glutamic acid, N[4[[(2-amino-5-formyl-1,4,5,6,7,8-hexahydro-4oxo-6-pteridinyl)methyl]amino]benzoyl], calcium salt (1:1)) | Wellcovorin ™, Leucovorin ™ | Immunex, Corp., Seattle, WA |
| levamisole HCl ((−)-(S)-2,3,5,6-tetrahydro-6-phenylimidazo [2,1-b] thiazole monohydrochloride $C_{11}H_{12}N_2S \cdot HCl$) | Ergamisol ™ | Janssen Research Foundation, Titusville, NJ |
| lomustine (1-(2-chloro-ethyl)-3-cyclohexyl-1-nitrosourea) | CeeNU ™ | Bristol-Myers Squibb |
| mechlorethamine, nitrogen mustard (2-chloro-N-(2-chloroethyl)-N-methylethanamine hydrochloride) | Mustargen ™ | Merck |
| megestrol acetate 17α(acetyloxy)-6-methylpregna-4,6-diene-3,20-dione | Megace ™ | Bristol-Myers Squibb |
| melphalan, L-PAM (4-[bis(2-chloroethyl) amino]-L-phenylalanine) | Alkeran ™ | GlaxoSmithKline |
| mercaptopurine, 6-MP (1,7-dihydro-6H-purine-6-thione monohydrate) | Purinethol ™ | GlaxoSmithKline |
| mesna (sodium 2-mercaptoethane sulfonate) | Mesnex ™ | Asta Medica |
| methotrexate (N-[4-[[(2,4-diamino-6-pteridinyl)methyl]methylamino]benzoyl]-L-glutamic acid) | Methotrexate ™ | Lederle Laboratories |
| methoxsalen (9-methoxy-7H-furo[3,2-g][1]-benzopyran-7-one) | Uvadex ™ | Therakos, Inc., Way Exton, Pa |
| mitomycin C | Mutamycin ™ | Bristol-Myers Squibb |
| mitomycin C | Mitozytrex ™ | SuperGen, Inc., Dublin, CA |
| mitotane (1,1-dichloro-2-(o-chlorophenyl)-2-(p-chlorophenyl) ethane) | Lysodren ™ | Bristol-Myers Squibb |
| mitoxantrone (1,4-dihydroxy-5,8-bis[[2-[(2-hydroxyethyl)amino]ethyl]amino]-9,10-anthracenedione dihydrochloride) | Novantrone ™ | Immunex Corporation |
| nandrolone phenpropionate | Durabolin-50 ™ | Organon, Inc., West Orange, NJ |
| nofetumomab | Verluma ™ | Boehringer Ingelheim Pharma KG, Germany |

TABLE 2-continued

Additional unclassified chemotherapy agents.

| Generic Name | Brand Name | Manufacturer |
|---|---|---|
| oprelvekin (IL-11) | Neumega ™ | Genetics Institute, Inc., Alexandria, VA |
| pamidronate (phosphonic acid (3-amino-1-hydroxypropylidene) bis-, disodium salt, pentahydrate, (APD)) | Aredia ™ | Novartis |
| pegademase ((monomethoxypolyethylene glycol succinimidyl) 11-17-adenosine deaminase) | Adagen ™ (Pegademase Bovine) | Enzon Pharmaceuticals, Inc., Bridgewater, NJ |
| pegaspargase (monomethoxypolyethylene glycol succinimidyl L-asparaginase) | Oncaspar ™ | Enzon |
| pegfilgrastim (covalent conjugate of recombinant methionyl human G-CSF (Filgrastim) and monomethoxypolyethylene glycol) | Neulasta ™ | Amgen, Inc |
| pentostatin | Nipent ™ | Parke-Davis Pharmaceutical Co., Rockville, MD |
| pipobroman | Vercyte ™ | Abbott Laboratories, Abbott Park, IL |
| plicamycin, mithramycin (antibiotic produced by *Streptomyces plicatus*) | Mithracin ™ | Pfizer, Inc., NY, NY |
| quinacrine (6-chloro-9-(1-methyl-4-diethyl-amine) butylamino-2-methoxyacridine) | Atabrine ™ | Abbott Labs |
| rasburicase (recombinant peptide) | Elitek ™ | Sanofi-Synthelabo, Inc., |
| sargramostim (recombinant peptide) | Prokine ™ | Immunex Corp |
| streptozocin (streptozocin 2-deoxy-2-[[[(methylnitrosoamino)carbonyl]amino]-a(and b)-D-glucopyranose and 220 mg citric acid anhydrous) | Zanosar ™ | Pharmacia & Upjohn Company |
| talc ($Mg_3Si_4O_{10}(OH)_2$) | Sclerosol ™ | Bryan, Corp., Woburn, MA |
| temozolomide (3,4-dihydro-3-methyl-4-oxoimidazo[5,1-d]-as-tetrazine-8-carboxamide) | Temodar ™ | Schering |
| teniposide, VM-26 (4'-demethylepipodophyllotoxin 9-[4,6-0-(R)-2-thenylidene-(beta)-D-glucopyranoside]) | Vumon ™ | Bristol-Myers Squibb |
| testolactone (13-hydroxy-3-oxo-13,17-secoandrosta-1,4-dien-17-oic acid [dgr]-lactone) | Teslac ™ | Bristol-Myers Squibb |
| thioguanine, 6-TG (2-amino-1,7-dihydro-6H-purine-6-thione) | Thioguanine ™ | GlaxoSmithKline |
| thiotepa (Aziridine, 1,1',1''-phosphinothioylidynetris-, or Tris (1-aziridinyl) phosphine sulfide) | Thioplex ™ | Immunex Corporation |
| topotecan HCl ((S)-10-[(dimethylamino) methyl]-4-ethyl-4,9-dihydroxy-1H-pyrano[3',4':6,7] indolizino [1,2-b] quinoline-3,14-(4H,12H)-dione monohydrochloride) | Hycamtin ™ | GlaxoSmithKline |
| toremifene (2-(p-[(Z)-4-chloro-1,2-diphenyl-1-butenyl]-phenoxy)-N,N-dimethylethylamine citrate (1:1)) | Fareston ™ | Roberts Pharmaceutical Corp., Eatontown, NJ |
| tositumomab, I 131 tositumomab (recombinant murine immunotherapeutic monoclonal $IgG_{2a}$ lambda anti-CD20 antibody (I131 is a radioimmunotherapeutic antibody)) | Bexxar ™ | Corixa Corp., Seattle, WA |
| tretinoin, ATRA (all-trans retinoic acid) | Vesanoid ™ | Roche |
| uracil mustard | Uracil Mustard Capsules ™ | Roberts Labs |
| valrubicin, N-trifluoroacetyladriamycin-14-valerate ((2S-cis)-2-[1,2,3,4,6,11-hexahydro-2,5,12-trihydroxy-7 methoxy-6,11-dioxo-[[4 2,3,6-trideoxy-3-[(trifluoroacetyl)-amino-α-L-lyxo- | Valstar ™ | Anthra --> Medeva |

TABLE 2-continued

Additional unclassified chemotherapy agents.

| Generic Name | Brand Name | Manufacturer |
|---|---|---|
| hexopyranosyl]oxyl]-2-naphthacenyl]-2-oxoethyl pentanoate) | | |
| zoledronate, zoledronic acid ((1-Hydroxy-2-imidazol-1-yl-phosphonoethyl) phosphonic acid monohydrate) | Zometa ™ | Novartis |

22. Cocktails

Chemotherapy agents can include cocktails of two or more chemotherapy drugs mentioned above. In several embodiments, a chemotherapy agent is a cocktail that includes two or more alkylating agents, platinums, anti-metabolites, anthracyclines, taxanes, camptothecins, nitrosoureas, EGFR inhibitors, antibiotics, HER2/neu inhibitors, angiogenesis inhibitors, kinase inhibitors, proteaosome inhibitors, immunotherapies, hormone therapies, photodynamic therapies, cancer vaccines, sphingolipid modulators, oligomers or combinations thereof.

In one embodiment, the chemotherapy agent is a cocktail that includes an immunotherapy, an alkylating agent, an anthracycline, a camptothecin and prednisone. In other embodiments, the chemotherapy agent is a cocktail that includes rituximab, an alkylating agent, an anthracycline, a camptothecin and prednisone. In other embodiments, the chemotherapy agent is a cocktail that includes rituximab, cyclophosphamide, an anthracycline, a camptothecin and prednisone. In still other embodiments, the chemotherapy agent is a cocktail that includes rituximab, cyclophosphamide, doxorubicin, vincristine and prednisone (e.g., R—CHOPS).

In another embodiment, the chemotherapy agent is a cocktail that includes doxorubicin, ifosfamide and mesna.

In other embodiments, the chemotherapy agent is a cocktail that includes an anti-metabolite and a taxane. For example, the chemotherapy agent includes gemcitabine and taxotere.

In other embodiments, the chemotherapy agent is a cocktail that includes dacarbazine, mitomycin, doxorubicin and cisplatin.

In other embodiments, the chemotherapy agent is a cocktail that includes doxorubicin and dacarbazine.

In alternative embodiments, the chemotherapy agent is a cocktail that includes an alkylating agent, a camptothecins, an anthracycline and dacarbazine. In other examples, the chemotherapy agent includes cyclophosphamide, vincristine, doxorubicin and dacarbazine.

In still other embodiments, the chemotherapy agent is a cocktail that includes an alkylating agent, methotrexate, an anti-metabolite and one or more anthracyclines. For example, the chemotherapy agent includes 5-fluorouracil, methotrexate, cyclophosphamide, doxorubicin and epirubicin.

In yet other embodiments, the chemotherapy agent is a cocktail that includes a taxane and prednisone or estramustine. For example, the chemotherapy agent can include docetaxel combined with prednisone or estramustine.

In still yet another embodiment, the chemotherapy agent includes an anthracycline and prednisone. For example, the chemotherapy agent can include mitoxantrone and prednisone.

In other embodiments, the chemotherapy agent includes a rapamycin macrolide and a kinase inhibitor. The kinase inhibitors can be EGFR, Her2/neu, VEGF, Aurora kinase, SRC/Abl kinase, tyrosine kinase and/or MEK inhibitors.

In another embodiment the chemotherapy agent includes two or more sphingolipid modulators.

In still another embodiment the chemotherapy agent includes an oligomer, such as Genasense® and one or more alkylating agents, platinums, anti-metabolites, anthracyclines, taxanes, camptothecins, nitrosoureas, EGFR inhibitors, antibiotics, HER2/neu inhibitors, angiogenesis inhibitors, kinase inhibitors, proteaosome inhibitors, immunotherapies, hormone therapies, photodynamic therapies, cancer vaccines, sphingolipid modulators or combinations thereof.

Moreover, the chemotherapy drug or drugs composing the chemotherapy agent can be administered in combination therapies with other agents, or they may be administered sequentially or concurrently to the patient.

C. Radiation Therapy

In several embodiments of the present invention, radiation therapy is administered in addition to the administration of an oligonucleotide compound. Radiation therapy includes both external and internal radiation therapies.

1. External Radiation Therapy

External radiation therapies include directing high-energy rays (e.g., x-rays, gamma rays, and the like) or particles (alpha particles, beta particles, protons, neutrons and the like) at the cancer and the normal tissue surrounding it. The radiation is produced outside the patient's body in a machine called a linear accelerator. External radiation therapies can be combined with chemotherapies, surgery or oligonucleotide compounds.

2. Internal Radiation Therapy

Internal radiation therapies include placing the source of the high-energy rays inside the body, as close as possible to the cancer cells. Internal radiation therapies can be combined with external radiation therapies, chemotherapies or surgery.

Radiation therapy can be administered with chemotherapy simultaneously, concurrently, or separately. Moreover radiation therapy can be administered with surgery simultaneously, concurrently, or separately.

D. Surgery

In alternative embodiments, of the present invention, surgery is used to remove cancerous tissue from a patient. Cancerous tissue can be excised from a patient using any suitable surgical procedure including, for example, laparoscopy, scalpel, laser, scissors and the like. In several embodiments, surgery is combined with chemotherapy. In other embodiments, surgery is combined with radiation therapy. In still other embodiments, surgery is combined with both chemotherapy and radiation therapy.

III. Pharmaceutical Compositions

In one aspect of the present invention, a pharmaceutical composition comprises one or more oligonucleotide compounds and a chemotherapy agent. For example, a pharmaceutical composition comprises an oligonucleotide compound having SEQ. ID NO. 1250, 1251, 1252, or 1253; and one or more of an alkylating agent, a platinum, an antimetabolite, an anthracycline, a taxane, a camptothecins, a nitrosourea, an EGFR inhibitor, an antibiotic, a HER2/neu inhibitor, an angiogenesis inhibitor, a proteaosome inhibitor, an immunotherapy, a hormone therapy, a photodynamic therapy, a cancer vaccine, other chemotherapy agents such as those illustrated in Table 1, or combinations thereof.

In one embodiment, the pharmaceutical composition comprises an oligonucleotide compound and a chemotherapy agent including an immunotherapy, an alkylating agent, an anthracycline, a camptothecin and prednisone. For example, the pharmaceutical composition comprises one or more oligonucleotide compounds comprising SEQ ID NOs 2-281, 283-461, 463-935, 937-1080, 1082-1248, 1250-1254 and 1267-1477, and complements thereof; and a chemotherapy agent including an immunotherapy, an alkylating agent, an anthracycline, a camptothecin, and prednisone. In other embodiments, the pharmaceutical composition comprises an oligonucleotide compound and a chemotherapy agent that includes rituximab, cyclophosphamide, an anthracycline, a camptothecin and prednisone. In still other embodiments, the pharmaceutical composition comprises an oligonucleotide and a chemotherapy agent including rituximab, cyclophosphamide, doxorubicin, vincristine and prednisone (e.g., R-CHOPS).

Other embodiments of the invention provide pharmaceutical compositions containing (a) one or more oligonucleotide compounds and (b) a chemotherapy agent. Examples of such chemotherapeutic agents include, without limitation, those listed above. Anti-inflammatory drugs, including but not limited to nonsteroidal anti-inflammatory drugs and corticosteroids, and antiviral drugs, including but not limited to ribivirin, vidarabine, acyclovir and ganciclovir, may also be combined in compositions of the invention. Other non-oligonucleotide chemotherapeutic agents are also within the scope of this invention. Two or more combined compounds may be used together or sequentially.

Pharmaceutical compositions of the present invention can optionally include medicaments such as anesthesia, nutritional supplements (e.g., vitamins, minerals, protein and the like), chromophores, combinations thereof, and the like.

A. Formulations, Administration and Uses

The compositions of the present invention may be administered orally, parenterally, by inhalation spray, topically, rectally, nasally, intraoccularly, buccally, vaginally, or via an implanted reservoir. The term "parenteral" as used herein includes subcutaneous, intravenous, intramuscular, intra-articular, intra-synovial, intrasternal, intrathecal, intrahepatic, intralesional and intracranial injection or infusion techniques. Preferably, the compositions are administered orally, intraperitoneally or intravenously. Sterile injectable forms of the compositions of this invention may be aqueous or oleaginous suspension. These suspensions may be formulated according to techniques known in the art using suitable dispersing or wetting agents and suspending agents. The sterile injectable preparation may also be a sterile injectable solution or suspension in a non-toxic parenterally-acceptable diluent or solvent, for example as a solution in 1,3-butanediol. Among the acceptable vehicles and solvents that may be employed are water, Ringer's solution and isotonic sodium chloride solution. In addition, sterile, fixed oils are conventionally employed as a solvent or suspending medium.

For this purpose, any bland fixed oil may be employed including synthetic mono- or di-glycerides. Fatty acids, such as oleic acid and its glyceride derivatives are useful in the preparation of injectables, as are natural pharmaceutically-acceptable oils, such as olive oil or castor oil, especially in their polyoxyethylated versions. These oil solutions or suspensions may also contain a long-chain alcohol diluent or dispersant, such as carboxymethyl cellulose or similar dispersing agents that are commonly used in the formulation of pharmaceutically acceptable dosage forms including emulsions and suspensions. Other commonly used surfactants, such as Tweens, Spans and other emulsifying agents or bioavailability enhancers which are commonly used in the manufacture of pharmaceutically acceptable solid, liquid, or other dosage forms may also be used for the purposes of formulation.

The pharmaceutically acceptable compositions of this invention may be orally administered in any orally acceptable dosage form including, but not limited to, capsules, tablets, aqueous suspensions or solutions. In the case of tablets for oral use, carriers commonly used include lactose and corn starch. Lubricating agents, such as magnesium stearate, are also typically added. For oral administration in a capsule form, useful diluents include lactose and dried cornstarch. When aqueous suspensions are required for oral use, the active ingredient is combined with emulsifying and suspending agents. If desired, certain sweetening, flavoring or coloring agents may also be added.

Alternatively, the pharmaceutically acceptable compositions of this invention may be administered in the form of suppositories for rectal administration. These can be prepared by mixing the agent with a suitable non-irritating excipient that is solid at room temperature but liquid at rectal temperature and therefore will melt in the rectum to release the drug. Such materials include cocoa butter, beeswax and polyethylene glycols.

The pharmaceutically acceptable compositions of this invention may also be administered topically, especially when the target of treatment includes areas or organs readily accessible by topical application, including diseases of the eye, the skin or the lower intestinal tract. Suitable topical formulations are readily prepared for each of these areas or organs.

Topical application for the lower intestinal tract can be effected in a rectal suppository formulation (see above) or in a suitable enema formulation. Topically-transdermal patches may also be used.

For topical applications, the pharmaceutically acceptable compositions may be formulated in a suitable ointment containing the active component suspended or dissolved in one or more carriers. Carriers for topical administration of the compounds of this invention include, but are not limited to, mineral oil, liquid petrolatum, white petrolatum, propylene glycol, polyoxyethylene, polyoxypropylene compound, emulsifying wax and water. Alternatively, the pharmaceutically acceptable compositions can be formulated in a suitable lotion or cream containing the active components suspended or dissolved in one or more pharmaceutically acceptable carriers. Suitable carriers include, but are not limited to, mineral oil, sorbitan monostearate, polysorbate 60, cetyl esters wax, cetearyl alcohol, 2-octyldodecanol, benzyl alcohol and water.

For ophthalmic use, the pharmaceutically acceptable compositions may be formulated as micronized suspensions in isotonic, pH adjusted sterile saline, or, preferably, as solutions in isotonic, pH adjusted sterile saline, either with or without a preservative such as benzylalkonium chloride. Alternatively, for ophthalmic uses, the pharmaceutically acceptable compositions may be formulated in an ointment such as petrolatum.

The pharmaceutically acceptable compositions of this invention may also be administered by nasal aerosol or inhalation. Such compositions are prepared according to techniques well-known in the art of pharmaceutical formulation and may be prepared as solutions in saline, employing benzyl alcohol or other suitable preservatives, absorption promoters to enhance bioavailability, fluorocarbons, and/or other conventional solubilizing or dispersing agents.

In several embodiments, the pharmaceutically acceptable compositions of this invention are formulated for oral administration.

The amount of the compounds of the present invention that may be combined with the carrier materials to produce a composition in a single dosage form will vary depending upon the host treated, the particular mode of administration. Preferably, the compositions should be formulated so that a dosage of between 0.01-100 mg/kg body weight/day of the modulator can be administered to a patient receiving these compositions.

It should also be understood that a specific dosage and treatment regimen for any particular patient will depend upon a variety of factors, including the activity of the specific compound employed, the age, body weight, general health, sex, diet, time of administration, rate of excretion, drug combination, and the judgment of the treating physician and the severity of the particular disease being treated. The amount of a compound of the present invention in the composition will also depend upon the particular compound in the composition.

Depending upon the particular condition, or disease, to be treated or prevented, additional therapeutic agents, which are normally administered to treat or prevent that condition, may also be present in the compositions of this invention. As used herein, additional therapeutic agents normally administered to treat or prevent a particular disease, or condition, are known as "appropriate for the disease, or condition, being treated."

B. Delivery

The oligonucleotide compounds of the present invention may be delivered using any suitable method. In some embodiments, naked DNA is administered. In other embodiments, lipofection is utilized for the delivery of nucleic acids to a subject. In still further embodiments, oligonucleotides are modified with phosphothiolates for delivery (See e.g., U.S. Pat. No. 6,169,177, herein incorporated by reference).

In some embodiments, nucleic acids for delivery are compacted to aid in their uptake (See e.g., U.S. Pat. Nos. 6,008, 366, 6,383,811 herein incorporated by reference). In some embodiments, compacted nucleic acids are targeted to a particular cell type (e.g., cancer cell) via a target cell binding moiety (See e.g., U.S. Pat. Nos. 5,844,107, 6,077,835, each of which is herein incorporated by reference).

In some embodiments, oligonucleotides are conjugated to other compounds to aid in their delivery. For example, in some embodiments, nucleic acids are conjugated to polyethylene glycol to aid in delivery (See e.g., U.S. Pat. Nos. 6,177, 274, 6,287,591, 6,447,752, 6,447,753, and 6,440,743, each of which is herein incorporated by reference). In yet other embodiments, oligonucleotides are conjugated to protected graft copolymers, which are chargeable" drug nano-carriers (PharmaIn), described in U.S. Pat. No. 7,138,105, and U.S. publication numbers 2006/093660 and 2006/0239924, which are incorporated herein by reference. In still further embodiments, the transport of oligonucleotides into cells is facilitated by conjugation to vitamins (Endocyte, Inc, West Lafayette, Ind.; See e.g., U.S. Pat. Nos. 5,108,921, 5,416,016, 5,635,382, 6,291,673 and WO 02/085908; each of which is herein incorporated by reference). In other embodiments, oligonucleotides are conjugated to nanoparticles (e.g., NanoMed Pharmaceuticals; Kalamazoo, Mich.).

In still other embodiments, oligonucleotides are associated with dendrimers. Dendrimers are synthetic macromolecules with highly branched molecular structures. Representative dendrimeric structures are cationic polymers such as starburst polyamidoamine (PAMAM), one of which, SuperFect®, is available from Qiagen (Valencia, Calif.). Other dendrimers include polyester dentrimers described by Gillies, et al., Mol. Pharm., 2:129-38, 2005, which is incorporated herein by reference; phenylacetylene dendrimers, described in Janssen and Meijer, eds, Synthesis of Polymers, Materials science and technology series, Weinheim, Germany: Wiley-VCH Verlag GMBH, Chapter 12, 1999, which is incorporated herein by reference; poly(L-lysine) dendrimer-block-poly(ethylene glycol)-block-poly(L-lysine) dendrimers described by Choi, et al., J. Am. Chem. Soc. 122, 474-80, 2000, which is incorporated herein by reference; amphiphilic dendrimers, described by Joester, et al., Angew Chem. Int. Ed. Engl., 42:1486-90, 2003, which is incorporated herein by reference; polyethylene glycol star like conjugates, described by Liu et al., Polym Chem, 37:3492-3503, 1999, which is incorporated herein by reference; cationic phosphorus-containing dendrimers described by Loup, et al., Chem Eur J, 5:3644-50, 1999, which is incorporated herein by reference; poly(L-lysine) dendrimers, described by Ohasaki, et al., Bioconjug Chem, 13:510-17, 2002, which is incorporated herein by reference and amphipathic asymmetric dendrimers, described by Shah, et al., Int. J. Pharm, 208:41-48, 2000, which is incorporated herein by reference. Poly propylene imine dendrimers, described in Tack, et al., J. Drug Target, 14; 69-86, 2006, which is incorporated herein by reference; and other dendrimers described above, can be chemically modified to reduce toxicity, for example, as described in Tack, et al.

Dendrimers complex with nucleic acids as do other cationic polymers with high charge density. In general, the dendrimer-nucleic acid interaction is based on electrostatic interactions. Dendrimers can be conjugated with other molecules, such as cyclodextrins to increase efficiency of systemic delivery of dendrimer-nucleic acid complexes. (See Dufes, et al., Adv. Drug Del. Rev, 57, 2177-2202, 2005, and Svenson and Tomalia, Adv. Drug Del. Rev., 57, 2106-29, 2005, both of which are incorporated herein by reference.) Some dendrimers have a flexible open structure that can capture small molecules in their interior, and others have an inaccessible interior. (See Svenson and Tomalia, Adv. Drug Del. Rev., 57, 2106-29, 2005.)

In further embodiments, oligonucleotides are sequestered in polymer vesicles. Polymer vesicles can be made from a number of different materials, but in general are formed from block copolymers, for example, polystyrene$_{40}$-poly(isocyano-L-alanine-L-alanine). (See for example, Discher, et al., Science, 297:967-73, 2002; Torchilin, Cell. Mol. Life. Sci, 61:2549-59, 2004; Taubert, et al., Curr Opin Chem Biol, 8:598-603, 2004; Lee, et al., Pharm. Res., 22:1-10, 2005; and Gaucher, et al., J. Control. Rel, 109:169-88, 2005, each of which is incorporated herein by reference.) Copolymer vesicles are formed from a number of molecules, including, without limitation, polyacrylic acid-polystyrene, nonionic polyethyleneoxide-polybutadiene, the triblock (polyethyleneoxide)$_5$-(poly[propyleneoxide])$_{68}$-(polyethyleneoxide)$_5$, polyethyleneoxide-poly(propylenesulfide), polyethyleneoxide-polylactide, and polyethylene glycol-polylysine. Many copolymers, particularly those of either amphiphilic or oppositely charged copolymers, including polystyrene$_{40}$-poly(isocyano-L-alanine-L-alanine)$_m$, self assemble into vesicles in aqueous conditions.

Oligonucleotides can be loaded into the polymer vesicles using several methods. First, the block copolymer can be dissolved along with the oligonucleotides in an aqueous solvent. This method works well with moderately hydrophobic copolymers. Second, for amphiphilic copolymers that are not readily soluble in water, and where a solvent that solubilizes both the oligonucleotides and the copolymer is available, the oligonucleotide and copolymer are dissolved in the solvent and the mixture is dialyzed against water. A third method involves dissolving both the oligonucleotides and copolymer in a water/tert-butanol mixture and subsequent lyophilization of the solvents. The oligonucleotide-loaded vesicles are formed spontaneously when the lyophilized oligonucleotide-copolymer is reconstituted in an injectable vehicle. (Dufresne, et al., in Gurny, (ed.), B. T. Gattefosse, vol. 96, Gattefosse, Saint-Priest, p. 87-102, 2003, which is incorporated herein by reference.)

Polymer vesicles can be targeted to specific cells by tethering a ligand to the outer shell of vesicles by post modification of a copolymer with a bifunctional spacer molecule or by the direct synthesis of heterobifunctional block copolymers.

In some embodiments, oligonucleotides are enclosed in lipids (e.g., liposomes or micelles) to aid in delivery (See e.g., U.S. Pat. Nos. 6,458,382, 6,429,200; U.S Patent Publications 2003/0099697, 2004/0120997, 2004/0131666, 2005/0164963, and International Publication WO 06/048329, each of which is herein incorporated by reference). Liposomes include, without limitation, cardiolipin based cationic liposomes (e.g., NeoPhectin, available from NeoPharm, Forest Lake, Ill.) and pH sensitive liposomes.

In some embodiments of the present invention, NeoPhectin is utilized as the liposomal delivery vehicle. In some embodiments, the NeoPhectin is formulated with the oligonucleotide so as to reduce free NeoPhectin. In other embodiments, NeoPhectin is present at a charge ratio 6:1 or less (e.g., 5:1, and 4:1) of NeoPhectin to oligonucleotide.

In yet other embodiments, lipids, particularly phospholipids that comprise some liposomes, are conjugated to polyethylene glycol or a derivative thereof, to increase the time that the liposomes circulate in the blood after intravenous injection. (See e.g., Moghimi, S. M. and Szebeni, J, Prog. Lipid Res., 42:463-78, 2003 and Li, W., et al., J. Gene Med., 7:67-79, 2005, which are incorporated herein by reference.) Such liposomes, termed "stealth liposomes" are able to avoid the reticuloentothelial system (RES), resulting in half lives of more than 24 hours in some cases. In one embodiment, the phospholipids in liposomes are conjugated to polyethylene glycol-diorthoester molecules, as described in Li, W., et al., J. Gene Med., 7:67-79, 2005. In other embodiments, the PEG-liposomes are targeted to specific cell receptors. For example, haloperidol conjugated at the distal end of a PEG-linked phospholipids in a cationic liposome targeted sigma receptors that are overexpressed on some cancer cells as described in Mukherjee, et al., J. Biol. Chem., 280, 15619-27, 2005, which is incorporated herein by reference. Anisamide conjugated to PEG-linked phospholipids in liposomes also targets the sigma receptor. (Banerjee, et al., Int. J. Cancer, 112, 693-700, 2004, which is incorporated herein by reference.)

In yet another embodiment, oligonucleotides can be sequestered in hybrid liposome-copolymer vesicles, as described in Ruysschaert, et. al., J. Am. Chem. Soc., 127, 6242-47, 2005, which is incorporated herein by reference. For example, an amphiphilic triblock copolymers, including poly(2-methyloxazoline)-block-poly(dimethylsiloxan)-block-poly(2-methyloxazoline) can interact with lipids, including phospholipids to form hybrid liposome-copolymer vesicles.

In still further embodiments, oligonucleotides are complexed with additional polymers to aid in delivery (See e.g., U.S. Pat. Nos. 6,379,966, 6,339,067, 5,744,335; each of which is herein incorporated by reference. For example, polymers of N-2-hydroxypropyl methylacrylamide are described in U.S. patent publication number 2006/0014695, which is incorporated herein by reference. Similar cationic polymers are described in International Patent Publication number WO 03/066054 and U.S. patent publication number 2006/0051315, both of which are incorporated herein by reference. Other polymers are described by Intradigm Corp., Rockville, Md.).

In still further embodiments, the controlled high pressure delivery system developed by Mirus (Madison, Wis.) is utilized for delivery of oligonucleotides. The delivery system is described in U.S. Pat. No. 6,379,966, which is incorporated herein by reference.

V. Examples of Cancer Therapies

The following examples are provided in order to demonstrate and further illustrate certain preferred embodiments and aspects of the present invention and are not to be construed as limiting the scope thereof.

Example 1

Administering to a patient an oligonucleotide compound; a chemotherapy agent including rituximab, cyclophosphamide, doxorubicin, vincristine, and prednisone; and radiation therapy.

Example 2

Administering to a patient an oligonucleotide compound, radiation therapy and surgery.

Example 3

Administering to a patient an oligonucleotide compound, a chemotherapy agent and radiation.

Example 4

Administering to a patient an oligonucleotide compound and a chemotherapy agent.

Example 5

Administering to a patient an oligonucleotide compound, a chemotherapy agent, radiation therapy and surgery.

Example 6

Inhibition of Tumor Growth in PC-3 Xenografts with PNT-100 and Taxotere™

Inhibition of tumor growth by PNT-100 (SEQ ID NO:1251) was examined using the human PC-3 GFP prostate carcinoma subcutaneous model. (See e.g., Yang et al., Cancer Research 59, 781-786, [1999]; Glinskii et al., Cancer Research 63, 4239-4243, [2003]; and Kalikin et al., Cancer Biology and Therapy 2:6, 17-21 [2003].)

PC-3 cells were first transduced with the green fluorescent protein (GFP) gene. A GFP expression vector, pLEIN, was purchased from Clontech (Palo Alto, Calif.). The vector expresses enhanced GFP and the neomycin resistance gene on the same bicistronic message that contains an internal ribosome entry site. To produce packaged GFP viral particles, PT67, an NIH3T3 derived packaging cell line, expressing the 10 AI viral envelopes (Clontech) was used. PT67 cells were cultured in DMEM supplemented with 10% fetal bovine serum. PT67 cells, at 70% confluence, were incubated with a precipitated mixture of N-[1-(2,3-dioleoyloxyl) propyl]-N, N,-trimethylammoniummethyl sulfate reagent and saturating amounts of pLEIN plasmid for 18 h. For selection, the cells were cultured in the presence of 200-1000 µg/ml G418 for 7 days. For GFP gene transduction, 20% confluent PC-3 cells (ATCC, CRL 1435) were incubated with a 1:1 precipitated mixture of retroviral supernatants of PT67 cells and Ham's F-12 K containing 7% fetal bovine serum for 72 h. Fresh medium was replenished at this time. PC-3 cells were harvested 72 h post transduction and subcultured at a ratio of 1:15 into selective medium that contained G-418. The brightest PC-3 cell clones expressing GFP were selected, combined, and then amplified and transferred by conventional culture methods.

Tumor stocks were prepared by subcutaneously injecting PC-3-GFP cells at a concentration of $5 \times 10^6$ cells/200 µl into the flank of nude mice (male athymic NCr nude mice between 5 and 6 weeks of age (Taconic Quality Laboratory Animals and Services for Research (Germantown, N.Y.)). Strong GFP expression of tumors grown in the subcutis of mice was certified before harvest. The tumor tissues harvested from subcutaneous growth in nude mice were inspected and any grossly necrotic or suspected necrotic or non GFP tumor tissues were removed. Tumor tissues were subsequently cut into small fragments of approximately 2 mm³. A tumor stock of the prostate cancer PC-3 GFP was established by subcutaneously injecting PC-3 GFP cells to the flank of nude mice. The tumor was maintained in nude mice subcutaneously as tumor stock prior to use. Before implantation, strong GFP expression of the PC-3 GFP tumor tissue was confirmed by fluorescent light. On the day of implantation, the tumor was harvested from the subcutaneous site and placed in RPMI-1640 medium. Necrotic tissues were removed and viable tissues were cut into 2 mm³ pieces. The tissue fragments were then implanted subcutaneously to right flank of the nude nice. Tumor size was measured by caliper monitoring. Approximate tumor volume was calculated by the formula (Width× Length)×½.

PNT100 (SEQ ID NO:1251) and PNT-1 (SEQ ID NO:1488) were formulated with NeoPhectin-ATT™ as follows. A 25 ml liposome delivery vehicle (LDV) consisting of NeoPhectin-ATT™ (NeoPharm, IL) bottle was placed at room temperature for 15 min. The bottle was gently swirled for 30 seconds to mix. 1000 µl LDV was transferred to 50 ml sterile polypropylene tubes labeled: Day #PNT100. The PNT100 stock tube was vortexed and quickly centrifuged. 75 µl PNT100 (Stock) was transferred to the Day #PNT100 tube and the mixture was vortexed vigorously for 2 minutes. 5000 µl dH2O was mixed with 5000 µl 20% sucrose in a sterile 50 ml tube. 2150 µl of the diluted sucrose was added to the PNT100/Neophectin-AT™ solution and mixed. An appropriate drug injection volume was transferred to a 1.5 ml polypropylene tube. The LDV control was generated by mixing 75 µl RNAse/DNAse free water instead of PNT100 with 1000 µl LDV, 2150 10% sucrose was added and the mixture was injected.

Mice bearing 50-100 mm³ estimated tumor volume were injected subcutaneously into the tumor with NeoPhectin-AT™-PNT-100 (SEQ ID NO:1251) or PNT-1 (SEQ ID NO:1488) at a dose of 2.5-5.0 mg/kg daily for five days. A second group of mice received 5-10 mg/kg of Taxotere™ intravenously on days 2 and 5. A third group of mice received 5 mg/kg of NeoPhectin-AT™-PNT-100 (SEQ ID NO:1251) injected subcutaneously into the tumor daily for five days and 5-10 mg/kg of Taxotere™ injected intravenously on days 2 and 5.

The study design is shown in Table 3

TABLE 3

| Subgroup ID | Description | Dose (mg/kg) | Schedule | Route | N |
|---|---|---|---|---|---|
| A | PBS Control | 200 µl | qd X 5 | s.c | 10 |
| B | PNT-C (5'-NNNNNNNNNNNNNNN NNNNNNNNNN-3'; SEQ ID NO: 1448) + LDV | 5 | qd X 5 | s.c. | 10 |
| C | PNT-100 (PhoMab12; SEQ ID NO: 1251) + LDV | 2.5 | qd X 5 | s.c. | 10 |
| D | PNT-100 + LDV | 5 | qd X 5 | s.c. | 10 |
| E | TAXOTERE ™ | 10 and 5 | Day 2 and 5 | i.v. | 10 |
| F | TAXOTERE ™ + PNT-100/LDV | 10 and 5 + 5 | Day 2 and 5 + qd X 5 | i.v. + s.c. | +10 |

Tumor growth was monitored for 40 days. Twelve days after implantation, whole body optical imaging of GFP-expressing tumors was performed once per week using a fluorescence microscope. The final tumor weights were taken after animals were sacrificed at the forty-sixth day of the study.

Figure 2:
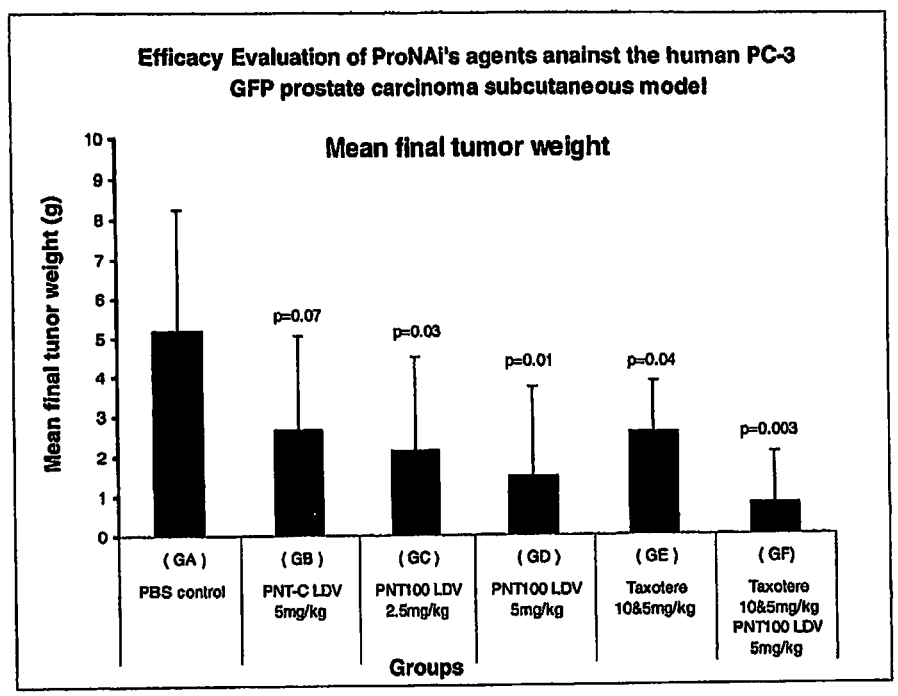
FIG. 2 shows mean final tumor volume of tumors in the PC-3 GFP prostate carcinoma subcutaneous model following treatment with SEQ ID NO: 1251 and Taxotere™.

Results are shown in FIGS. 1 and 2. FIG. 1 shows mean tumor volume of tumors in the PC-3 GFP prostate carcinoma subcutaneous model following treatment with PNT-100 and/or Taxotere™. FIG. 2 shows mean final volume of tumors. The results indicate that PNT-100+Taxotere™ is more effective than PNT-100 or Taxotere™ alone.

Example 7

Inhibition of Tumor Growth in a Non-Hodgkin's Model with PNT-100 and Vincristine A non-Hodgkin's-lymphoma model (NHL) was used. The WSU-DLCL₂ (Wayne State University diffuse large cell lymphoma) model is a very robust model of chemoresistant aggressive human diffuse large cell lymphoma. It was obtained from Dr. Ramzi Mohammad and Dr. Al-Katib and colleagues at the Karmanos Cancer Institute at Wayne State University. (See Al-Katib, A M, et al., Clin. Cancer Res. 4, 1305-1314 (1998); Mohammad, R, et al., Clin. Cancer Res. 8, 1277-1283 (2002); Mohammad, R M, et al., Mol. Cancer. Ther., 4, 13-21 (2005); Mohammad, R M, et al., Clin. Cancer Res. 6, 4950-4956, (2000).) The study was designed to administer five daily doses of 5 mg/kg PNT-100 (SEQ ID NO: 1251), and in certain cohorts, combination therapy with vincristine. After one dose of PNT-100, noticeable weight loss in the animals injected with PNT100 and PNT-1 (SEQ ID NO:1488) was observed. The data shows decreased tumor burden with combination therapy with PNT-100 and PNT-1 20 days post WSU-DLCL2 transplantation. The results indicate that PNT-100, alone and in combination with vincristine, decreases the growth tumors in mice.

Example 8

Figure 3:
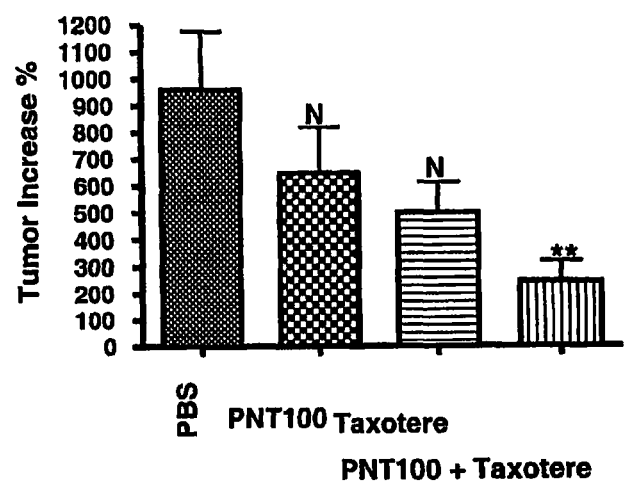
FIG. 3 shows percentage increase in tumor size in PC-3 xenografts following treatment with SEQ ID NO: 1251 and Taxotere™.

Efficacy of PNT-100 and Taxotere™ Intravenous Delivery in the PC-3 Xenograft Model Xenografts were generated by subcutaneous injection of $2\times10^6$ PC-3 cells in nude mice. A 6:1 PNT100:NeoPhectin AT™ charge ratio was prepared as described in Example 6. Mice bearing 50-100 mm³ xenografts were dosed intravenously with 1 mg/kg PNT-100+NeoPhectin AT™, daily for 5 days, with 10 mg/kg on day 2 and with 5 m/kg on day 5 with Taxotere™. Tumor response was measured by caliper monitoring. Results are shown in FIG. 3, which indicate PNT-100 with Taxotere™ is more efficacious than PNT-100 or Taxotere™ alone.

Example 9

Efficacy of Liposomal PNT-100 and Docetaxel in PC-3 Xenografts

Figure 4:
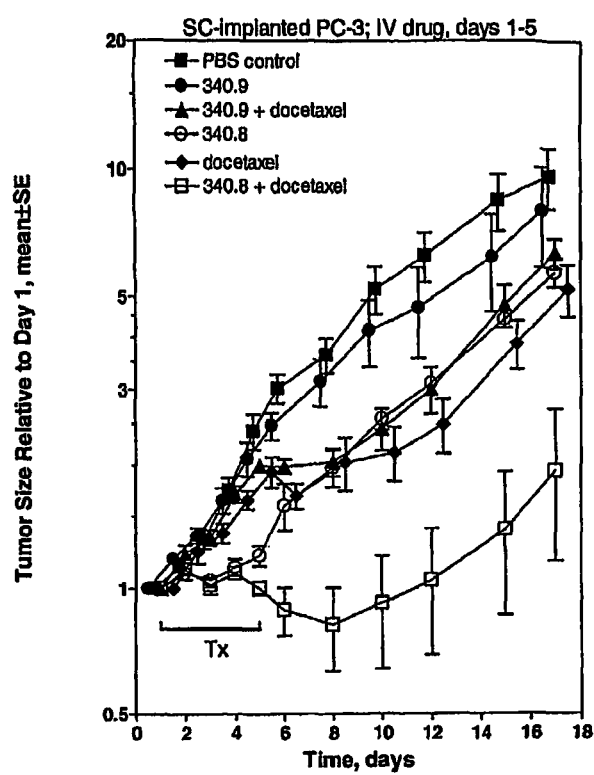
FIG. 4 shows the response of PC-3 tumors in mice to liposomal PNT-100 and docetaxel.

Xenografts were generated by subcutaneous injection of $2\times10^6$ PC-3 cells in nude mice. PNT-100 was formulated in a lipid formulation of POPC/DOPE/MoChol/CHEMS in the molar ratio of 6/24/47/23. (See U.S. Patent application Nos. 2003/0099697, 2004/40120997, 2004/0131666, and International Application Publication No. WO/05/094783, all of which are incorporated herein by reference.) The mean size of the liposomes is less than 160 ηm, and the concentration of PNT-100 in the liposomal mixture is about 2 mg/ml. Two different batches of liposomal PNT-100 were used, 340.8 and 340.9. Mice bearing 50-200 mm3 xenografts were dosed on day 1 with PNT-100 (SEQ ID NO:1251) or PNT100R (SEQ ID NO:1288). Dosing was 10 mg/kg on days 1, 2, and 5 and 7.5 mg/kg on days 3 and 4. Docetaxel dosing was 10 mg/kg on day 2 and 5 mg/kg on day 5. Mann-Whitney analysis with a student t test was performed with 95% confidence. N=5 except for 340.8+docetaxel, in which N=4. Results are shown in FIG. 4 demonstrating a reduction in tumor size with PNT-100+docetaxel compared to PNT-100 or docetaxel alone.

Figure 5:
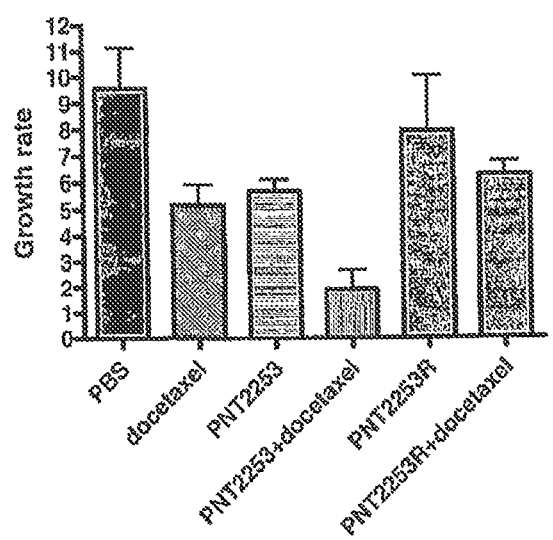
FIG. 5 shows the response of PC-3 tumors in mice to liposomal PNT-100 and docetaxel delivered by i.v. bolus injection.
Figure 6:
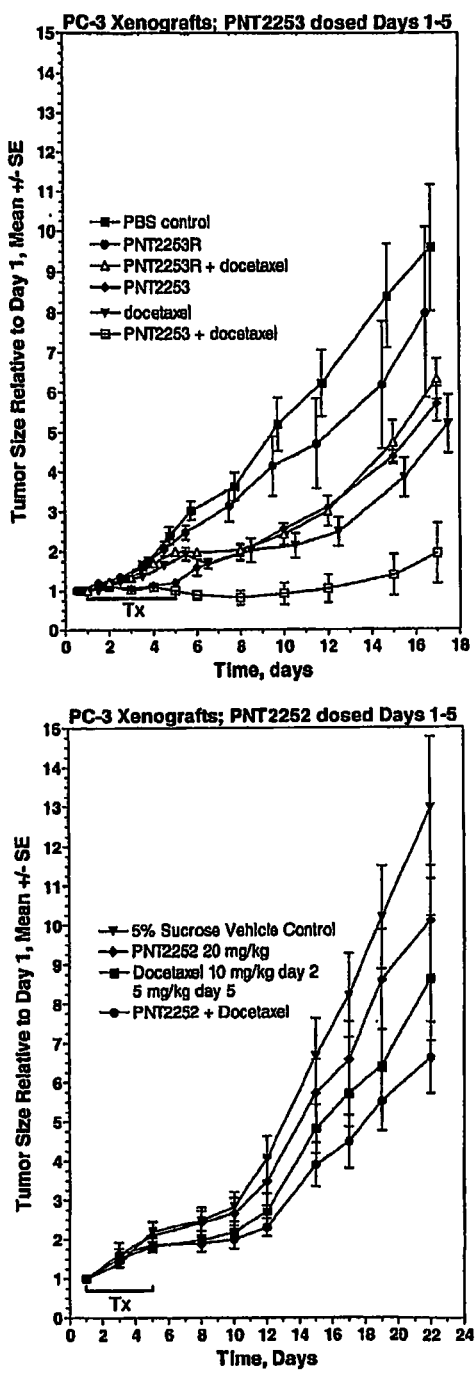
FIG. 6 shows the response of PC-3 tumors in mice to liposomal PNT-100 and docetaxel delivered by i.v. bolus injection and slow infusion.

A repetition of the experiment gave similar results. One batch of liposomal-PNT-100, called PNT-2253 was prepared with the same properties as above. Xenograft bearing mice were administered 10 mg/kg of liposomal PNT-100 (PNT2253) or liposomal PNT-100R (PNT2253R) by i.v. bolus injection daily for five days. Docetaxel dosing was 10 mg/kg on day 2 and 5 mg/kg on day 5 by i.v. bolus injection. Tumor volume was caliper measured. Studies were concluded when control animal xenografts reached 2000 mm³. Results are shown in FIGS. 5 and 6, showing an 80% tumor growth inhibition for PNT-100+docetaxel. A second batch of liposomal PNT-100 (PNT2252) was administered by i.v. slow infusion. Dosing was 20 mg/kg daily for 5 days, and docetaxel was administered at 10 mg/kg on day 2 and 5 mg/kg on day 5 by i.v. bolus injection. Results in FIG. 6 show 49% tumor growth inhibition for PNT2252+docetaxel at 17 days after drug treatment.

Example 10

Efficacy of Liposomal PNT-100 and Rituximab in WSU-DLCL2 Xenografts

Xenografts with WSU-DLCL2 cells were generated in C.B-17 SCID mice between 4-6 weeks old as described in the previous examples. Liposomal PNT-100 was formulated as in example 9 and has similar properties and a concentration of 2 mg PNT-100 per ml. Human pharmaceutical grade rituximab (Biogen Idec-Genentech) was provided by Karmanos Cancer Institute. The mice were treated as in Table 4.

TABLE 4

| Group ID | Description | Liposomal PNT-100 Dose Volume (Per 25 g mouse) | Schedule | Route | n |
| --- | --- | --- | --- | --- | --- |
| A | 10% Sucrose Control | 125 µl | qd x 5 | i.v. | 8 |
| B | 10 mg/kg Liposomal PNT-100 | 125 µl | qd x 5 | i.v. | 7* |
| C | 20 mg/kg Rituxan ™ | NA | Day 2 & Day 5 | i.v. | 8 |
| D | 10 mg/kg Liposomal PNT-100 20 mg/kg Rituxan ™ | 125 µl | qd x 5 Day 2 & Day 5 | i.v. | 8 |

Note:
Dosage listed as mg/ml PNT100
*One animal did not develop palpable tumor.

Animals were checked three times weekly for tumor growth by caliper measurements. An approximate tumor volume was calculated using the formula $\frac{1}{2}(a\times b^2)$, where b is the smaller of two perpendicular diameters. Animals were sacrificed when individual animal tumor burden reached 2000 mm³ or when the study was concluded 81 days post tumor trocar.

Rituximab at 20 mg/kg, administered on days 2 and 5 resulted in complete regression of the tumor, i.e., tumor shrinkage below measurable size for three consecutive time points, in seven out of eight tumors and four out of eight showed complete regression through the 81 day endpoint. Liposomal PNT-100 at 10 mg/ml, administered daily for five days resulted in complete regression of the tumor in one out of seven tumors and none of the tumors showed complete regression through the 81 day endpoint. One out of seven tumors had a partial regression, which is a less than 50% reduction from initial tumor size for three consecutive time points. Administration of liposomal PNT-100 resulted in a slowing of the growth rate of the tumor when compared to the sucrose control. Liposomal PNT-100 administered along with rituximab (group D), resulted in complete regression of the tumor in six out of eight of the tumors, and 5 out of 8 tumors showed complete regression through the 81 day endpoint. All eight tumors had partial regressions. These results did not establish synergy of rituximab+PNT-100, in WSU-DLCL₂ xenografts, probably because the rituximab levels administered were high.

Example 11

Efficacy of Liposomal PNT-100 and Rituximab in Daudi Xenografts

Daudi cells are a model of Burkett's lymphoma. Xenografts with Daudi cells were generated in mice as described in the previous examples. Liposomal PNT-100 was formulated as in example 9 and has similar properties and a concentration of 2.4 mg PNT-100 per ml. The mice were divided into 10 groups and treated as in Table 5.

TABLE 5

| Group ID | Description | Dose (mg/kg) | Schedule | Route | N |
|---|---|---|---|---|---|
| 1 | PBS Control | 200 μl | qd X 5 | i.v. | 10 |
| 2 | Rituximab | 20 mg/kg | Schedule 2 | i.v. | 10 |
| 3 | Liposomal PNT-100 | 30 mg/kg | Schedule 1 | i.v. | 10 |
| 4 | Liposomal PNT-100 | 20 mg/kg | Schedule 1 | i.v. | 10 |
| 5 | Liposomal PNT-100 | 13.3 mg/kg | Schedule 1 | i.v. | 10 |
| 6 | Liposomal PNT-100 | 8.89 mg/kg | Schedule 1 | i.v. | 10 |
| 7 | Liposomal PNT-100 | 5.92 mg/kg | Schedule 1 | i.v. | 10 |
| 8 | Rituximab + Liposomal PNT-100 | 20 mg/kg RTX, 20 mg/kg PNT-100 | Schedule 1-rituximab, Schedule 2-PNT-100 | i.v. | 10 |
| 9 | Rituximab + Liposomal PNT-100 | 20 mg/kg RTX, 13.3 mg/kg PNT-100 | Schedule 1-rituximab, Schedule 2-PNT-100 | i.v. | 10 |

Schedule 1 is 5 daily doses, 2 days off and then 5 daily doses, 2 days off, then 3 daily doses.
Schedule 2 is i.v. delivery of rituximab biweekly for 2.5 weeks for a total of 5 injections.

Tumor volume was caliper measured. Studies were concluded when control animal xenografts reached 2000 mm$^3$.

Figure 7:
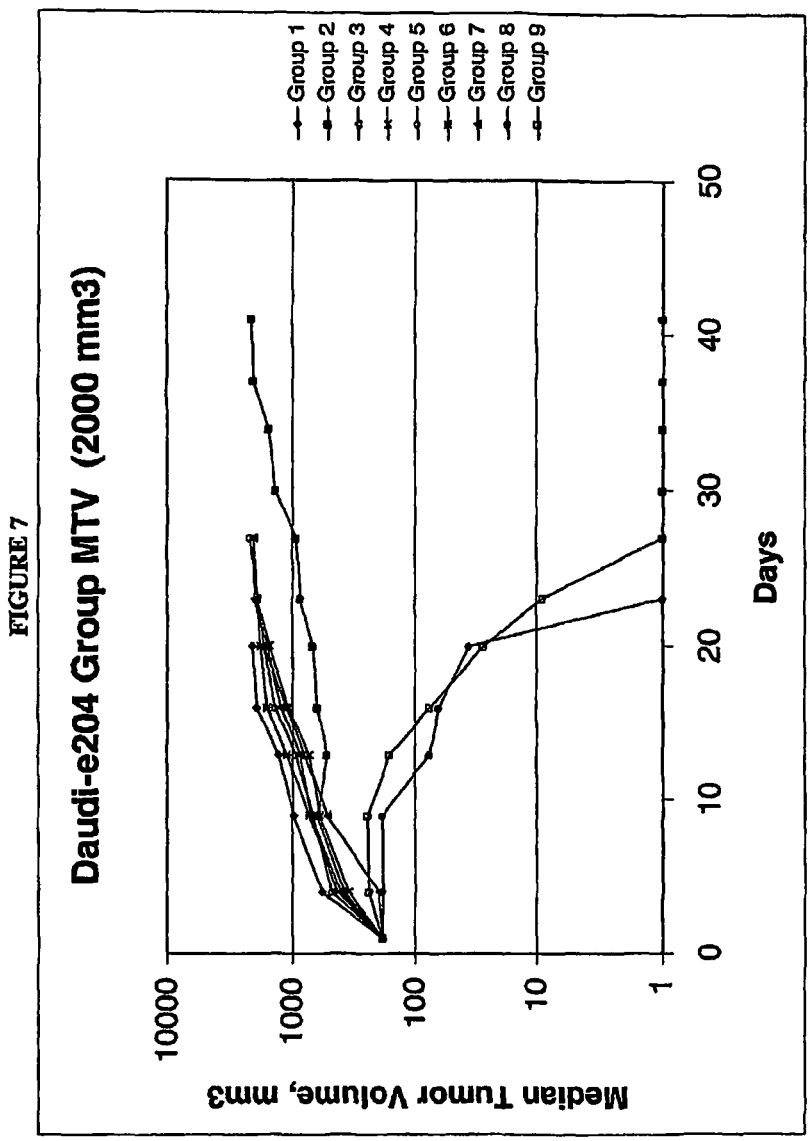
FIG. 7 shows the response of Daudi xenografts to PNT-100 and rituximab.
Figure 8:
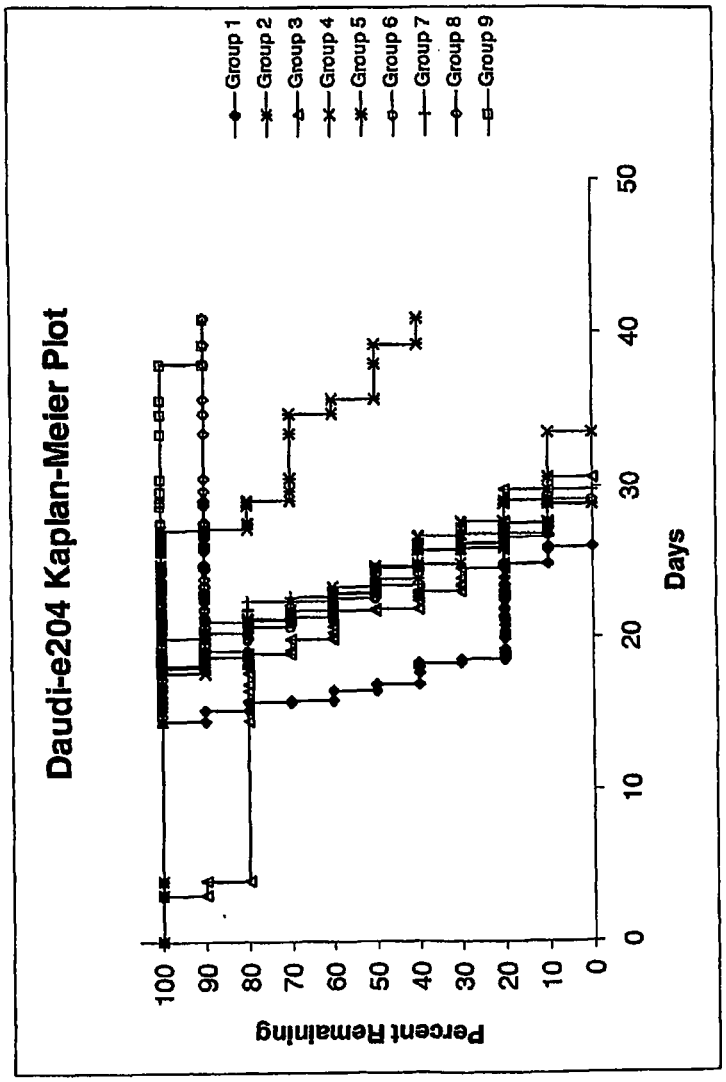
FIG. 8 shows a Kaplan-Meier plot of the response of Daudi xenografts to PNT-100 and rituximab.
Figure 9:
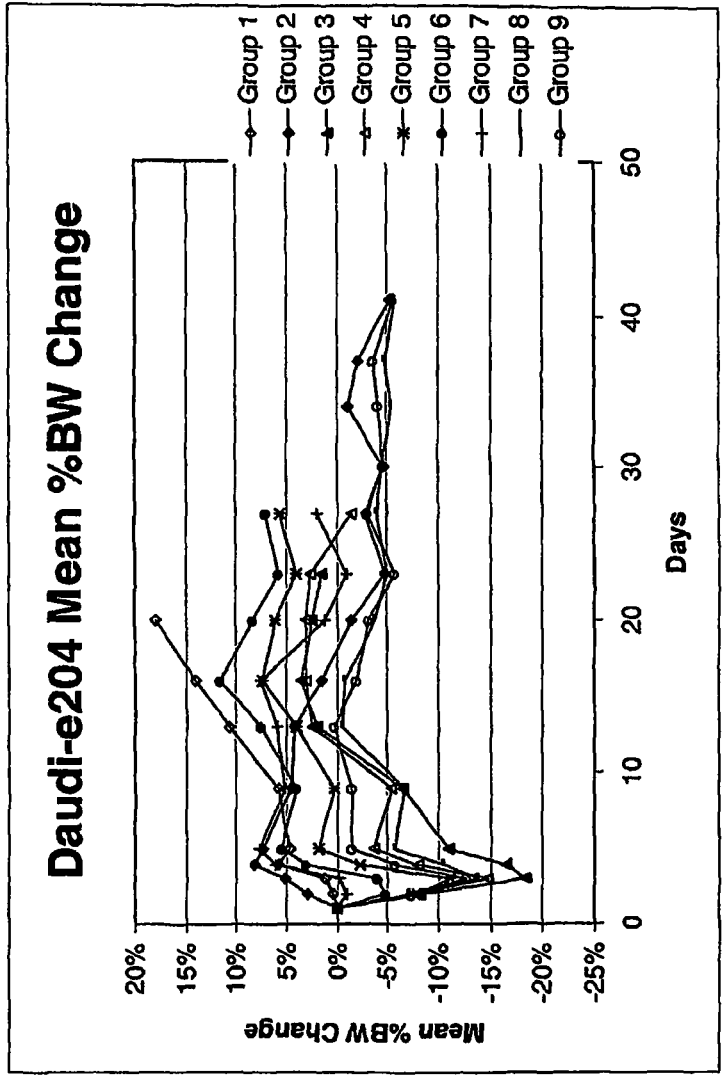
FIG. 9 shows the body weight change of Daudi xenograft-bearing mice treated with PNT-100 and/or rituximab.

Results are shown in FIGS. 8-10. FIG. 7 shows mean tumor volume up to 50 days. FIG. 8 is a Kaplan-Meyer plot, showing the percent of mice whose tumors have not yet reached 2000 mm$^3$ each day. FIG. 9 shows the change in body weight of the mice in each group. The results show little effect with either rituximab or PNT-100 alone, but a dramatic effect, when PNT-100 and rituximab are given together. Indeed, in Daudi xenografts, the tumors shrink and disappear when the mice bearing them are treated with PNT-100 and rituximab.

VI. Other Embodiments

It is to be understood that while the invention has been described in conjunction with the detailed description thereof, the foregoing description is intended to illustrate and not limit the scope of the invention, which is defined by the scope of the appended claims. Other aspects, advantages and modifications are within the scope of the following claims.

All references cited herein, are incorporated herein by reference in their entirety.

SEQUENCE LISTING (1479 sequences)

SEQ ID NO: 1 - DNA, 541 bp, Homo sapiens
cccgggggtcctggaagccacaaggtaaacacaacacatccccctccttgactatcaattttactagaggatgtggtgggaaaaccattatttgatattaaaacaaataggcttgggatggagtaggatgcaagctccccaggaaagtttaagataaaacctgagacttaaaagggtgttaagagtggcagcctagggaatttatcccggactccgggggagggggcagagtcaccagcctctgcatttagggattctccgaggaaaagtgtgagaacggctgcaggcaacccaggcgtcccggcgctaggagggacgcacccaggcctgcgcgaagagagggagaaagtgaagctgggagttgccactcccagacttgttggaatgcagttggagggggcgagctgggagcgcgcttgctcccaatcacaggagaaggaggaggtggaggaggagggctgcttgaggaagtataagaatgaagttgtgaagctgagattcccctccattgggaccggagaaaccaggggagccccccggg

SEQ ID NO: 2 - DNA, 24 bp, Artificial
  synthetic oligonucleotide
  modified_base (4)..(4): c or methylated C nucleotide
  modified_base (6)..(6): c or methylated C nucleotide
  modified_base (17)..(17): c or methylated C nucleotide
aagcgcgctcccagctcgccccct

SEQ ID NO: 3 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccggg

SEQ ID NO: 4 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccct

SEQ ID NO: 5 - DNA, 33 bp, Artificial
  synthetic oligonucleotide
  modified_base (1)..(1): c or methylated C nucleotide
  modified_base (3)..(3): c or methylated C nucleotide
  modified_base (17)..(17): c or methylated C nucleotide
  modified_base (29)..(29): c or methylated C nucleotide
  modified_base (32)..(32): c or methylated C nucleotide
cgcgcaggcctgggtgcgtccctcctagcgccg

SEQ ID NO: 6 - DNA, 25 bp, Artificial
  synthetic oligonucleotide
  modified_base (4)..(4): c or methylated C nucleotide
  modified_base (22)..(22): c or methylated C nucleotide
agccgttctcacacttttcctcgga

SEQ ID NO: 7 - DNA, 24 bp, Artificial
  synthetic oligonucleotide
  modified_base (13)..(13): c or methylated C nucleotide
  modified_base (20)..(20): c or methylated C nucleotide
tgccccctcccccggagtccggga

SEQ ID NO: 8 - DNA, 33 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccct

SEQ ID NO: 9 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgg

SEQ ID NO: 10 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgg

SEQ ID NO: 11 - DNA, 21 bp, Artificial
  synthetic oligonucleotide
gtggcttccaggacccccggg

SEQ ID NO: 12 - DNA, 24 bp, Artificial
  synthetic oligonucleotide
  modified_base (13)..(13): c or methylated C nucleotide
  modified_base (20)..(20): c or methylated C nucleotide
tgccccctcccccggagtccggga

SEQ ID NO: 13 - DNA, 33 bp, Artificial; identical to SEQ ID NO: 8
  synthetic oligonucleotide
  modified_base (13)..(13): c or methylated C nucleotide
  modified_base (15)..(15): c or methylated C nucleotide
  modified_base (26)..(26): c or methylated C nucleotide

SEQ ID NO: 14 - DNA, 35 bp, Artificial; identical to SEQ ID NO: 9
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide

SEQ ID NO: 15 - DNA, 34 bp, Artificial; identical to SEQ ID NO: 10
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide

SEQ ID NO: 16 - DNA, 19 bp, Artificial
  synthetic oligonucleotide
  modified_base (2)..(2): c or methylated C nucleotide
  modified_base (14)..(14): c or methylated C nucleotide
  modified_base (17)..(17): c or methylated C nucleotide
gcgtccctcctagcgccgg

SEQ ID NO: 17 - DNA, 29 bp, Artificial
  synthetic oligonucleotide
cccgggggggctccctggtttctccggtc

SEQ ID NO: 18 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccggg

SEQ ID NO: 19 - DNA, 26 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
ctgggtgcgtccctcctagcgccggg

SEQ ID NO: 20 - DNA, 27 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
cctgggtgcgtccctcctagcgccggg

SEQ ID NO: 21 - DNA, 28 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgccggg

SEQ ID NO: 22 - DNA, 29 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
ggcctgggtgcgtccctcctagcgccggg

SEQ ID NO: 23 - DNA, 30 bp, Artificial
  synthetic oligonucleotide
  modified_base (12)..(12): c or methylated C nucleotide
  modified_base (24)..(24): c or methylated C nucleotide
  modified_base (27)..(27): c or methylated C nucleotide
aggcctgggtgcgtccctcctagcgccggg

SEQ ID NO: 24 - DNA, 26 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccggga

SEQ ID NO: 25 - DNA, 27 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaa

SEQ ID NO: 26 - DNA, 28 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaag

SEQ ID NO: 27 - DNA, 29 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaagc

SEQ ID NO: 28 - DNA, 30 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaagct

SEQ ID NO: 29 - DNA, 27 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
ctgggtgcgtccctcctagcgccggga

SEQ ID NO: 30 - DNA, 29 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
cctgggtgcgtccctcctagcgccgggaa

SEQ ID NO: 31 - DNA, 31 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgccgggaag

SEQ ID NO: 32 - DNA, 33 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
ggcctgggtgcgtccctcctagcgccgggaagc

SEQ ID NO: 33 - DNA, 35 bp, Artificial
  synthetic oligonucleotide
  modified_base (12)..(12): c or methylated C nucleotide
  modified_base (24)..(24): c or methylated C nucleotide
  modified_base (27)..(27): c or methylated C nucleotide
aggcctgggtgcgtccctcctagcgccgggaagct

SEQ ID NO: 34 - DNA, 25 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgcc

SEQ ID NO: 35 - DNA, 25 bp, Artificial
  synthetic oligonucleotide
  modified_base (13)..(13): c or methylated C nucleotide
  modified_base (25)..(25): c or methylated C nucleotide
caggcctgggtgcgtccctcctagc

SEQ ID NO: 36 - DNA, 25 bp, Artificial
  synthetic oligonucleotide
  modified_base (16)..(16): c or methylated C nucleotide
gcgcaggcctgggtgcgtccctcct

SEQ ID NO: 37 - DNA, 25 bp, Artificial
  synthetic oligonucleotide
  modified_base (19)..(19): c or methylated C nucleotide
ttcgcgcaggcctgggtgcgtccct

SEQ ID NO: 38 - DNA, 25 bp, Artificial
  synthetic oligonucleotide
  modified_base (22)..(22): c or methylated C nucleotide
ctcttcgcgcaggcctgggtgcgtc

SEQ ID NO: 39 - DNA, 25 bp, Artificial
  synthetic oligonucleotide
  modified_base (4)..(4): c or methylated C nucleotide
  modified_base (16)..(16): c or methylated C nucleotide
  modified_base (19)..(19): c or methylated C nucleotide
gtgcgtccctcctagcgccgggaag

SEQ ID NO: 40 - DNA, 25 bp, Artificial
  synthetic oligonucleotide
  modified_base (1)..(1): c or methylated C nucleotide
  modified_base (13)..(13): c or methylated C nucleotide
  modified_base (16)..(16): c or methylated C nucleotide
cgtccctcctagcgccgggaagctg

SEQ ID NO: 41 - DNA, 25 bp, Artificial
  synthetic oligonucleotide
  modified_base (10)..(10): c or methylated C nucleotide
  modified_base (13)..(13): c or methylated C nucleotide
ccctcctagcgccgggaagctgggt

SEQ ID NO: 42 - DNA, 25 bp, Artificial
  synthetic oligonucleotide
  modified_base (7)..(7): c or methylated C nucleotide
  modified_base (10)..(10): c or methylated C nucleotide
tcctagcgccgggaagctgggttgc

SEQ ID NO: 43 - DNA, 25 bp, Artificial
  synthetic oligonucleotide
  modified_base (4)..(4): c or methylated C nucleotide
  modified_base (7)..(7): c or methylated C nucleotide
tagcgccgggaagctgggttgcctg

SEQ ID NO: 44 - DNA, 23 bp, Artificial
  synthetic oligonucleotide
  modified_base (5)..(5): c or methylated C nucleotide
  modified_base (17)..(17): c or methylated C nucleotide
  modified_base (20)..(20): c or methylated C nucleotide
ggtgcgtccctcctagcgccggg

SEQ ID NO: 45 - DNA, 21 bp, Artificial
  synthetic oligonucleotide
  modified_base (3)..(3): c or methylated C nucleotide
  modified_base (15)..(15): c or methylated C nucleotide
  modified_base (18)..(18): c or methylated C nucleotide
tgcgtccctcctagcgccggg

SEQ ID NO: 46 - DNA, 19 bp, Artificial
  synthetic oligonucleotide
  modified_base (1)..(1): c or methylated C nucleotide
  modified_base (13)..(13): c or methylated C nucleotide
  modified_base (16)..(16): c or methylated C nucleotide
cgtccctcctagcgccggg

SEQ ID NO: 47 - DNA, 17 bp, Artificial
  synthetic oligonucleotide
  modified_base (11)..(11): c or methylated C nucleotide
  modified_base (14)..(14): c or methylated C nucleotide
tccctcctagcgccggg

SEQ ID NO: 48 - DNA, 15 bp, Artificial
  synthetic oligonucleotide
  modified_base (9)..(9): c or methylated C nucleotide
  modified_base (12)..(12): c or methylated C nucleotide
cctcctagcgccggg

SEQ ID NO: 49 - DNA, 23 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccg

SEQ ID NO: 50 - DNA, 21 bp, Artificial
  synthetic oligonucleotide
  modified_base (7)..(7): c or methylated C nucleotide
  modified_base (19)..(19): c or methylated C nucleotide
tgggtgcgtccctcctagcgc

SEQ ID NO: 51 - DNA, 19 bp, Artificial
  synthetic oligonucleotide
  modified_base (7)..(7): c or methylated C nucleotide
  modified_base (19)..(19): c or methylated C nucleotide
tgggtgcgtccctcctagc

SEQ ID NO: 52 - DNA, 17 bp, Artificial
  synthetic oligonucleotide
  modified_base (7)..(7): c or methylated C nucleotide
tgggtgcgtccctccta

SEQ ID NO: 53 - DNA, 15 bp, Artificial
  synthetic oligonucleotide
  modified_base (7)..(7): c or methylated C nucleotide
tgggtgcgtccctcc

SEQ ID NO: 54 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcatccctcctagcgccggg

SEQ ID NO: 55 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgtgtgcgtccctcctagcgccggg

SEQ ID NO: 56 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctaccgccggg

SEQ ID NO: 57 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccct

SEQ ID NO: 58 - DNA, 27 bp, Artificial
  synthetic oligonucleotide
  modified_base (4)..(4): c or methylated C nucleotide
  modified_base (7)..(7): c or methylated C nucleotide
  modified_base (21)..(21): c or methylated C nucleotide
cttcgccgcaggcctgggtgcgtccct

SEQ ID NO: 59 - DNA, 28 bp, Artificial
  synthetic oligonucleotide
  modified_base (5)..(5): c or methylated C nucleotide
  modified_base (8)..(8): c or methylated C nucleotide
  modified_base (22)..(22): c or methylated C nucleotide
tcttcgccgcaggcctgggtgcgtccct

SEQ ID NO: 60 - DNA, 29 bp, Artificial
  synthetic oligonucleotide
  modified_base (6)..(6): c or methylated C nucleotide
  modified_base (9)..(9): c or methylated C nucleotide
  modified_base (23)..(23): c or methylated C nucleotide
ctcttcgccgcaggcctgggtgcgtccct

SEQ ID NO: 61 - DNA, 30 bp, Artificial
  synthetic oligonucleotide
  modified_base (7)..(7): c or methylated C nucleotide
  modified_base (10)..(10): c or methylated C nucleotide
  modified_base (24)..(24): c or methylated C nucleotide
tctcttcgccgcaggcctgggtgcgtccct

SEQ ID NO: 62 - DNA, 31 bp, Artificial
  synthetic oligonucleotide
  modified_base (8)..(8): c or methylated C nucleotide
  modified_base (11)..(11): c or methylated C nucleotide
  modified_base (25)..(25): c or methylated C nucleotide
ctctcttcgccgcaggcctgggtgcgtccct

SEQ ID NO: 63 - DNA, 27 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctc

SEQ ID NO: 64 - DNA, 28 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctcc

SEQ ID NO: 65 - DNA, 29 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctcct

SEQ ID NO: 66 - DNA, 30 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctccta

SEQ ID NO: 67 - DNA, 31 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctcctag

SEQ ID NO: 68 - DNA, 28 bp, Artificial
  synthetic oligonucleotide
  modified_base (4)..(4): c or methylated C nucleotide
  modified_base (7)..(7): c or methylated C nucleotide
  modified_base (21)..(21): c or methylated C nucleotide
cttcgccgcaggcctgggtgcgtccctc

SEQ ID NO: 69 - DNA, 30 bp, Artificial
  synthetic oligonucleotide
  modified_base (5)..(5): c or methylated C nucleotide
  modified_base (8)..(8): c or methylated C nucleotide
  modified_base (22)..(22): c or methylated C nucleotide
tcttcgccgcaggcctgggtgcgtccctcc

SEQ ID NO: 70 - DNA, 32 bp, Artificial
  synthetic oligonucleotide
  modified_base (6)..(6): c or methylated C nucleotide
  modified_base (9)..(9): c or methylated C nucleotide
  modified_base (23)..(23): c or methylated C nucleotide
ctcttcgccgcaggcctgggtgcgtccctcct

SEQ ID NO: 71 - DNA, 34 bp, Artificial
  synthetic oligonucleotide
  modified_base (7)..(7): c or methylated C nucleotide
  modified_base (10)..(10): c or methylated C nucleotide
  modified_base (24)..(24): c or methylated C nucleotide
tctcttcgccgcaggcctgggtgcgtccctccta

SEQ ID NO: 72 - DNA, 36 bp, Artificial
  synthetic oligonucleotide
  modified_base (8)..(8): c or methylated C nucleotide
  modified_base (11)..(11): c or methylated C nucleotide
  modified_base (25)..(25): c or methylated C nucleotide
ctctcttcgccgcaggcctgggtgcgtccctcctag

SEQ ID NO: 73 - DNA, 26 bp, Artificial
  synthetic oligonucleotide
  modified_base (6)..(6): c or methylated C nucleotide
  modified_base (9)..(9): c or methylated C nucleotide
  modified_base (23)..(23): c or methylated C nucleotide
ctcttcgccgcaggcctgggtgcgtc

SEQ ID NO: 74 - DNA, 26 bp, Artificial
  synthetic oligonucleotide
  modified_base (9)..(9): c or methylated C nucleotide
  modified_base (12)..(12): c or methylated C nucleotide
  modified_base (26)..(26): c or methylated C nucleotide
cctctcttcgccgcaggcctgggtgc

SEQ ID NO: 75 - DNA, 26 bp, Artificial
  synthetic oligonucleotide
  modified_base (12)..(12): c or methylated C nucleotide
  modified_base (15)..(15): c or methylated C nucleotide
ctccctctcttcgccgcaggcctggg

SEQ ID NO: 76 - DNA, 26 bp, Artificial
  synthetic oligonucleotide
  modified_base (15)..(15): c or methylated C nucleotide
  modified_base (18)..(18): c or methylated C nucleotide
tttctccctctcttcgccgcaggcct

SEQ ID NO: 77 - DNA, 26 bp, Artificial
  synthetic oligonucleotide
  modified_base (18)..(18): c or methylated C nucleotide
  modified_base (21)..(21): c or methylated C nucleotide
cactttctccctctcttcgccgcagg

SEQ ID NO: 78 - DNA, 26 bp, Artificial
  synthetic oligonucleotide
  modified_base (3)..(3): c or methylated C nucleotide
  modified_base (17)..(17): c or methylated C nucleotide
gccgcaggcctgggtgcgtccctcct

SEQ ID NO: 79 - DNA, 26 bp, Artificial
  synthetic oligonucleotide
  modified_base (14)..(14): c or methylated C nucleotide
gcaggcctgggtgcgtccctcctagc

SEQ ID NO: 80 - DNA, 26 bp, Artificial
  synthetic oligonucleotide
  modified_base (11)..(11): c or methylated C nucleotide
ggcctgggtgcgtccctcctagcgcc

SEQ ID NO: 81 - DNA, 26 bp, Artificial
  synthetic oligonucleotide
  modified_base (8)..(8): c or methylated C nucleotide
ctgggtgcgtccctcctagcgccggg

SEQ ID NO: 82 - DNA, 26 bp, Artificial
  synthetic oligonucleotide
  modified_base (5)..(5): c or methylated C nucleotide
ggtgcgtccctcctagcgccgggaag

SEQ ID NO: 83 - DNA, 24 bp, Artificial
  synthetic oligonucleotide
  modified_base (1)..(1): c or methylated C nucleotide
  modified_base (4)..(4): c or methylated C nucleotide
  modified_base (18)..(18): c or methylated C nucleotide
cgccgcaggcctgggtgcgtccct

SEQ ID NO: 84 - DNA, 22 bp, Artificial
  synthetic oligonucleotide
  modified_base (2)..(2): c or methylated C nucleotide
  modified_base (16)..(16): c or methylated C nucleotide
ccgcaggcctgggtgcgtccct

SEQ ID NO: 85 - DNA, 20 bp, Artificial
  synthetic oligonucleotide
  modified_base (14)..(14): c or methylated C nucleotide
gcaggcctgggtgcgtccct

SEQ ID NO: 86 - DNA, 18 bp, Artificial
  synthetic oligonucleotide
  modified_base (12)..(12): c or methylated C nucleotide
aggcctgggtgcgtccct

SEQ ID NO: 87 - DNA, 16 bp, Artificial
  synthetic oligonucleotide
  modified_base (10)..(10): c or methylated C nucleotide
gcctgggtgcgtccct

SEQ ID NO: 88 - DNA, 15 bp, Artificial
  synthetic oligonucleotide
  modified_base (9)..(9): c or methylated C nucleotide
cctgggtgcgtccct

SEQ ID NO: 89 - DNA, 24 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtcc

SEQ ID NO: 90 - DNA, 22 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgt

SEQ ID NO: 91 - DNA, 20 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgc

SEQ ID NO: 92 - DNA, 18 bp, Artificial
  synthetic oligonucleotide
  modified_base (3)..(3): c or methylated C nucleotide
  modified_base (6)..(6): c or methylated C nucleotide
ttcgccgcaggcctgggt

SEQ ID NO: 93 - DNA, 16 bp, Artificial
  synthetic oligonucleotide
  modified_base (3)..(3): c or methylated C nucleotide
  modified_base (6)..(6): c or methylated C nucleotide
ttcgccgcaggcctgg

SEQ ID NO: 94 - DNA, 15 bp, Artificial
  synthetic oligonucleotide
  modified_base (3)..(3): c or methylated C nucleotide
  modified_base (6)..(6): c or methylated C nucleotide
ttcgccgcaggcctg

SEQ ID NO: 95 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcaccgcaggcctgggtgcgtccct

SEQ ID NO: 96 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgtgtgcgtccct

SEQ ID NO: 97 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtacct

SEQ ID NO: 98 - DNA, 24 bp, Artificial
  synthetic oligonucleotide
  modified_base (13)..(13): c or methylated C nucleotide
  modified_base (20)..(20): c or methylated C nucleotide
tgccccctcccccggagtccggga

SEQ ID NO: 99 - DNA, 25 bp, Artificial
  synthetic oligonucleotide
  modified_base (14)..(14): c or methylated C nucleotide
  modified_base (21)..(21): c or methylated C nucleotide
ctgccccctcccccggagtccggga

SEQ ID NO: 100 - DNA, 26 bp, Artificial
  synthetic oligonucleotide
  modified_base (15)..(15): c or methylated C nucleotide
  modified_base (22)..(22): c or methylated C nucleotide
tctgccccctcccccggagtccggga

SEQ ID NO: 101 - DNA, 27 bp, Artificial
  synthetic oligonucleotide
  modified_base (16)..(16): c or methylated C nucleotide
  modified_base (23)..(23): c or methylated C nucleotide
ctctgccccctcccccggagtccggga

SEQ ID NO: 102 - DNA, 28 bp, Artificial
  synthetic oligonucleotide
  modified_base (17)..(17): c or methylated C nucleotide
  modified_base (24)..(24): c or methylated C nucleotide
actctgccccctcccccggagtccggga

SEQ ID NO: 103 - DNA, 29 bp, Artificial
  synthetic oligonucleotide
  modified_base (18)..(18): c or methylated C nucleotide
  modified_base (25)..(25): c or methylated C nucleotide
gactctgccccctcccccggagtccggga

SEQ ID NO: 104 - DNA, 25 bp, Artificial
  synthetic oligonucleotide
  modified_base (13)..(13): c or methylated C nucleotide
  modified_base (20)..(20): c or methylated C nucleotide
tgccccctcccccggagtccgggat

SEQ ID NO: 105 - DNA, 26 bp, Artificial
  synthetic oligonucleotide
  modified_base (13)..(13): c or methylated C nucleotide
  modified_base (20)..(20): c or methylated C nucleotide
tgccccctcccccggagtccgggata

SEQ ID NO: 106 - DNA, 27 bp, Artificial
  synthetic oligonucleotide
  modified_base (13)..(13): c or methylated C nucleotide
  modified_base (20)..(20): c or methylated C nucleotide
tgccccctcccccggagtccgggataa

SEQ ID NO: 107 - DNA, 28 bp, Artificial
  synthetic oligonucleotide
  modified_base (13)..(13): c or methylated C nucleotide
  modified_base (20)..(20): c or methylated C nucleotide
tgccccctcccccggagtccgggataaa

SEQ ID NO: 108 - DNA, 29 bp, Artificial
  synthetic oligonucleotide
  modified_base (13)..(13): c or methylated C nucleotide
  modified_base (20)..(20): c or methylated C nucleotide
tgccccctcccccggagtccgggataaat

SEQ ID NO: 109 - DNA, 26 bp, Artificial
  synthetic oligonucleotide
  modified_base (14)..(14): c or methylated C nucleotide
  modified_base (21)..(21): c or methylated C nucleotide
ctgccccctcccccggagtccgggat

SEQ ID NO: 110 - DNA, 28 bp, Artificial
  synthetic oligonucleotide
  modified_base (15)..(15): c or methylated C nucleotide
  modified_base (22)..(22): c or methylated C nucleotide
tctgccccctcccccggagtccgggata

SEQ ID NO: 111 - DNA, 30 bp, Artificial
  synthetic oligonucleotide
  modified_base (16)..(16): c or methylated C nucleotide
  modified_base (23)..(23): c or methylated C nucleotide
ctctgccccctcccccggagtccgggataa

SEQ ID NO: 112 - DNA, 32 bp, Artificial
  synthetic oligonucleotide
  modified_base (17)..(17): c or methylated C nucleotide
  modified_base (24)..(24): c or methylated C nucleotide
actctgccccctcccccggagtccgggataaa

SEQ ID NO: 113 - DNA, 34 bp, Artificial
  synthetic oligonucleotide
  modified_base (18)..(18): c or methylated C nucleotide
  modified_base (25)..(25): c or methylated C nucleotide
gactctgccccctcccccggagtccgggataaat

SEQ ID NO: 114 - DNA, 24 bp, Artificial
  synthetic oligonucleotide
  modified_base (16)..(16): c or methylated C nucleotide
  modified_base (23)..(23): c or methylated C nucleotide
ctctgccccctcccccggagtccg

SEQ ID NO: 115 - DNA, 24 bp, Artificial
  synthetic oligonucleotide
  modified_base (19)..(19): c or methylated C nucleotide
tgactctgccccctcccccggagt

SEQ ID NO: 116 - DNA, 24 bp, Artificial
  synthetic oligonucleotide
  modified_base (22)..(22): c or methylated C nucleotide
tggtgactctgccccctcccccgg

SEQ ID NO: 117 - DNA, 24 bp, Artificial
  synthetic oligonucleotide
ggctggtgactctgccccctcccc

SEQ ID NO: 118 - DNA, 24 bp, Artificial
  synthetic oligonucleotide
agaggctggtgactctgccccctc

SEQ ID NO: 119 - DNA, 24 bp, Artificial
  synthetic oligonucleotide
  modified_base (10)..(10): c or methylated C nucleotide
  modified_base (17)..(17): c or methylated C nucleotide
cccctcccccggagtccgggataa

SEQ ID NO: 120 - DNA, 24 bp, Artificial
  synthetic oligonucleotide
  modified_base (7)..(7): c or methylated C nucleotide
  modified_base (14)..(14): c or methylated C nucleotide
ctcccccggagtccgggataaatt

SEQ ID NO: 121 - DNA, 24 bp, Artificial
  synthetic oligonucleotide
  modified_base (4)..(4): c or methylated C nucleotide
  modified_base (11)..(11): c or methylated C nucleotide
ccccggagtccgggataaattccc

SEQ ID NO: 122 - DNA, 24 bp, Artificial
  synthetic oligonucleotide
  modified_base (1)..(1): c or methylated C nucleotide
  modified_base (8)..(8): c or methylated C nucleotide
cggagtccgggataaattccctag

SEQ ID NO: 123 - DNA, 24 bp, Artificial
  synthetic oligonucleotide
  modified_base (5)..(5): c or methylated C nucleotide
agtccgggataaattccctaggct

SEQ ID NO: 124 - DNA, 22 bp, Artificial
  synthetic oligonucleotide
  modified_base (11)..(11): c or methylated C nucleotide
  modified_base (18)..(18): c or methylated C nucleotide
ccccctcccccggagtccggga

SEQ ID NO: 125 - DNA, 20 bp, Artificial
  synthetic oligonucleotide
  modified_base (9)..(9): c or methylated C nucleotide
  modified_base (16)..(16): c or methylated C nucleotide
ccctcccccggagtccggga

SEQ ID NO: 126 - DNA, 18 bp, Artificial
  synthetic oligonucleotide
  modified_base (7)..(7): c or methylated C nucleotide
  modified_base (14)..(14): c or methylated C nucleotide
ctcccccggagtccggga

SEQ ID NO: 127 - DNA, 16 bp, Artificial
  synthetic oligonucleotide
  modified_base (5)..(5): c or methylated C nucleotide
  modified_base (12)..(12): c or methylated C nucleotide
cccccggagtccggga

SEQ ID NO: 128 - DNA, 15 bp, Artificial
  synthetic oligonucleotide
  modified_base (4)..(4): c or methylated C nucleotide
  modified_base (11)..(11): c or methylated C nucleotide
ccccggagtccggga

SEQ ID NO: 129 - DNA, 22 bp, Artificial
  synthetic oligonucleotide
  modified_base (13)..(13): c or methylated C nucleotide
  modified_base (20)..(20): c or methylated C nucleotide
tgccccctcccccggagtccgg

SEQ ID NO: 130 - DNA, 20 bp, Artificial
  synthetic oligonucleotide
  modified_base (13)..(13): c or methylated C nucleotide
  modified_base (20)..(20): c or methylated C nucleotide
tgccccctcccccggagtcc

SEQ ID NO: 131 - DNA, 18 bp, Artificial
  synthetic oligonucleotide
  modified_base (13)..(13): c or methylated C nucleotide
tgccccctcccccggagt

SEQ ID NO: 132 - DNA, 16 bp, Artificial
  synthetic oligonucleotide
  modified_base (13)..(13): c or methylated C nucleotide
tgccccctcccccgga

SEQ ID NO: 133 - DNA, 15 bp, Artificial
  synthetic oligonucleotide
  modified_base (13)..(13): c or methylated C nucleotide
tgccccctcccccgg

SEQ ID NO: 134 - DNA, 24 bp, Artificial
  synthetic oligonucleotide
  modified_base (13)..(13): c or methylated C nucleotide
  modified_base (20)..(20): c or methylated C nucleotide
tgccccctctcccggagtccggga

SEQ ID NO: 135 - DNA, 24 bp, Artificial
  synthetic oligonucleotide
  modified_base (13)..(13): c or methylated C nucleotide
  modified_base (20)..(20): c or methylated C nucleotide
tgccccctcccccggagtacggga

SEQ ID NO: 136 - DNA, 24 bp, Artificial
  synthetic oligonucleotide
  modified_base (13)..(13): c or methylated C nucleotide
  modified_base (20)..(20): c or methylated C nucleotide
tgcccgctcccccggagtccggga

SEQ ID NO: 137 - DNA, 33 bp, Artificial; identical to SEQ ID NO: 8
  synthetic oligonucleotide
  modified_base (13)..(13): c or methylated C nucleotide
  modified_base (15)..(15): c or methylated C nucleotide
  modified_base (26)..(26): c or methylated C nucleotide

SEQ ID NO: 138 - DNA, 34 bp, Artificial
  synthetic oligonucleotide
  modified_base (14)..(14): c or methylated C nucleotide
  modified_base (16)..(16): c or methylated C nucleotide
  modified_base (27)..(27): c or methylated C nucleotide
gattgggagcaagcgcgctcccagctcgccccct

SEQ ID NO: 139 - DNA, 35 bp, Artificial
  synthetic oligonucleotide
  modified_base (15)..(15): c or methylated C nucleotide
  modified_base (17)..(17): c or methylated C nucleotide
  modified_base (28)..(28): c or methylated C nucleotide
tgattgggagcaagcgcgctcccagctcgccccct

SEQ ID NO: 140 - DNA, 36 bp, Artificial
  synthetic oligonucleotide
  modified_base (16)..(16): c or methylated C nucleotide
  modified_base (18)..(18): c or methylated C nucleotide
  modified_base (29)..(29): c or methylated C nucleotide
gtgattgggagcaagcgcgctcccagctcgccccct

SEQ ID NO: 141 - DNA, 37 bp, Artificial
  synthetic oligonucleotide
  modified_base (17)..(17): c or methylated C nucleotide
  modified_base (19)..(19): c or methylated C nucleotide
  modified_base (30)..(30): c or methylated C nucleotide
tgtgattgggagcaagcgcgctcccagctcgccccct

SEQ ID NO: 142 - DNA, 38 bp, Artificial
  synthetic oligonucleotide
  modified_base (18)..(18): c or methylated C nucleotide
  modified_base (20)..(20): c or methylated C nucleotide
  modified_base (31)..(31): c or methylated C nucleotide
ctgtgattgggagcaagcgcgctcccagctcgccccct

SEQ ID NO: 143 - DNA, 34 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctc

SEQ ID NO: 144 - DNA, 35 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctcc

SEQ ID NO: 145 - DNA, 36 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctcca

SEQ ID NO: 146 - DNA, 37 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctccaa

SEQ ID NO: 147 - DNA, 38 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctccaac

SEQ ID NO: 148 - DNA, 35 bp, Artificial
  synthetic oligonucleotide
gattgggagcaagcgcgctcccagctcgccccctc

SEQ ID NO: 149 - DNA, 37 bp, Artificial
  synthetic oligonucleotide
tgattgggagcaagcgcgctcccagctcgccccctcc

SEQ ID NO: 150 - DNA, 39 bp, Artificial
  synthetic oligonucleotide
gtgattgggagcaagcgcgctcccagctcgccccctcca

SEQ ID NO: 151 - DNA, 41 bp, Artificial
  synthetic oligonucleotide
tgtgattgggagcaagcgcgctcccagctcgccccctccaa

SEQ ID NO: 152 - DNA, 43 bp, Artificial
  synthetic oligonucleotide
ctgtgattgggagcaagcgcgctcccagctcgccccctccaac

SEQ ID NO: 153 - DNA, 33 bp, Artificial
  synthetic oligonucleotide
  modified_base (16)..(16): c or methylated C nucleotide
  modified_base (18)..(18): c or methylated C nucleotide
  modified_base (29)..(29): c or methylated C nucleotide
gtgattgggagcaagcgcgctcccagctcgccc

SEQ ID NO: 154 - DNA, 33 bp, Artificial
  synthetic oligonucleotide
  modified_base (19)..(19): c or methylated C nucleotide
  modified_base (21)..(21): c or methylated C nucleotide
  modified_base (32)..(32): c or methylated C nucleotide
cctgtgattgggagcaagcgcgctcccagctcg

SEQ ID NO: 155 - DNA, 33 bp, Artificial
  synthetic oligonucleotide
  modified_base (22)..(22): c or methylated C nucleotide
  modified_base (24)..(24): c or methylated C nucleotide
tctcctgtgattgggagcaagcgcgctcccagc

SEQ ID NO: 156 - DNA, 33 bp, Artificial
  synthetic oligonucleotide
  modified_base (25)..(25): c or methylated C nucleotide
  modified_base (27)..(27): c or methylated C nucleotide
ccttctcctgtgattgggagcaagcgcgctccc

SEQ ID NO: 157 - DNA, 33 bp, Artificial
  synthetic oligonucleotide
  modified_base (28)..(28): c or methylated C nucleotide
  modified_base (30)..(30): c or methylated C nucleotide
cctccttctcctgtgattgggagcaagcgcgct

SEQ ID NO: 158 - DNA, 33 bp, Artificial
  synthetic oligonucleotide
  modified_base (10)..(10): c or methylated C nucleotide
  modified_base (12)..(12): c or methylated C nucleotide
  modified_base (23)..(23): c or methylated C nucleotide
gggagcaagcgcgctcccagctcgccccctcca

SEQ ID NO: 159 - DNA, 33 bp, Artificial
  synthetic oligonucleotide
  modified_base (7)..(7): c or methylated C nucleotide
  modified_base (9)..(9): c or methylated C nucleotide
  modified_base (20)..(20): c or methylated C nucleotide
agcaagcgcgctcccagctcgccccctccaact

SEQ ID NO: 160 - DNA, 33 bp, Artificial
  synthetic oligonucleotide
  modified_base (4)..(4): c or methylated C nucleotide
  modified_base (6)..(6): c or methylated C nucleotide
  modified_base (17)..(17): c or methylated C nucleotide
aagcgcgctcccagctcgccccctccaactgca

SEQ ID NO: 161 - DNA, 33 bp, Artificial
  synthetic oligonucleotide
  modified_base (1)..(1): c or methylated C nucleotide
  modified_base (3)..(3): c or methylated C nucleotide
  modified_base (14)..(14): c or methylated C nucleotide
cgcgctcccagctcgccccctccaactgcattc

SEQ ID NO: 162 - DNA, 33 bp, Artificial
  synthetic oligonucleotide
  modified_base (11)..(11): c or methylated C nucleotide
gctcccagctcgccccctccaactgcattccaa

SEQ ID NO: 163 - DNA, 31 bp, Artificial
  synthetic oligonucleotide
  modified_base (11)..(11): c or methylated C nucleotide
  modified_base (13)..(13): c or methylated C nucleotide
  modified_base (24)..(24): c or methylated C nucleotide
tgggagcaagcgcgctcccagctcgccccct

SEQ ID NO: 164 - DNA, 29 bp, Artificial
  synthetic oligonucleotide
  modified_base (9)..(9): c or methylated C nucleotide
  modified_base (11)..(11): c or methylated C nucleotide
  modified_base (22)..(22): c or methylated C nucleotide
ggagcaagcgcgctcccagctcgccccct

SEQ ID NO: 165 - DNA, 27 bp, Artificial
  synthetic oligonucleotide
  modified_base (7)..(7): c or methylated C nucleotide
  modified_base (9)..(9): c or methylated C nucleotide
  modified_base (20)..(20): c or methylated C nucleotide
agcaagcgcgctcccagctcgccccct

SEQ ID NO: 166 - DNA, 25 bp, Artificial
  synthetic oligonucleotide
  modified_base (5)..(5): c or methylated C nucleotide
  modified_base (7)..(7): c or methylated C nucleotide
  modified_base (18)..(18): c or methylated C nucleotide
caagcgcgctcccagctcgccccct

SEQ ID NO: 167 - DNA, 23 bp, Artificial
  synthetic oligonucleotide
  modified_base (3)..(3): c or methylated C nucleotide
  modified_base (5)..(5): c or methylated C nucleotide
  modified_base (16)..(16): c or methylated C nucleotide
agcgcgctcccagctcgccccct

SEQ ID NO: 168 - DNA, 21 bp, Artificial
  synthetic oligonucleotide
  modified_base (1)..(1): c or methylated C nucleotide
  modified_base (3)..(3): c or methylated C nucleotide
  modified_base (14)..(14): c or methylated C nucleotide
cgcgctcccagctcgccccct

SEQ ID NO: 169 - DNA, 19 bp, Artificial
  synthetic oligonucleotide
  modified_base (1)..(1): c or methylated C nucleotide
  modified_base (12)..(12): c or methylated C nucleotide
cgctcccagctcgccccct

SEQ ID NO: 170 - DNA, 17 bp, Artificial
  synthetic oligonucleotide
  modified_base (10)..(10): c or methylated C nucleotide
ctcccagctcgccccct

SEQ ID NO: 171 - DNA, 15 bp, Artificial
  synthetic oligonucleotide
  modified_base (8)..(8): c or methylated C nucleotide
cccagctcgccccct

SEQ ID NO: 172 - DNA, 31 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgcccc

SEQ ID NO: 173 - DNA, 29 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgcc

SEQ ID NO: 174 - DNA, 27 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcg

SEQ ID NO: 175 - DNA, 25 bp, Artificial
  synthetic oligonucleotide
  modified_base (13)..(13): c or methylated C nucleotide
  modified_base (15)..(15): c or methylated C nucleotide
attgggagcaagcgcgctcccagct

SEQ ID NO: 176 - DNA, 23 bp, Artificial
  synthetic oligonucleotide
  modified_base (13)..(13): c or methylated C nucleotide
  modified_base (15)..(15): c or methylated C nucleotide
attgggagcaagcgcgctcccag

SEQ ID NO: 177 - DNA, 21 bp, Artificial
  synthetic oligonucleotide
  modified_base (13)..(13): c or methylated C nucleotide
  modified_base (15)..(15): c or methylated C nucleotide
attgggagcaagcgcgctccc

SEQ ID NO: 178 - DNA, 19 bp, Artificial
  synthetic oligonucleotide
  modified_base (13)..(13): c or methylated C nucleotide
  modified_base (15)..(15): c or methylated C nucleotide
attgggagcaagcgcgctc

SEQ ID NO: 179 - DNA, 17 bp, Artificial
  synthetic oligonucleotide
  modified_base (13)..(13): c or methylated C nucleotide
  modified_base (15)..(15): c or methylated C nucleotide
attgggagcaagcgcgc

SEQ ID NO: 180 - DNA, 15 bp, Artificial
  synthetic oligonucleotide
  modified_base (13)..(13): c or methylated C nucleotide
  modified_base (15)..(15): c or methylated C nucleotide
attgggagcaagcgc

SEQ ID NO: 181 - DNA, 33 bp, Artificial
  synthetic oligonucleotide
  modified_base (13)..(13)
  modified_base (15)..(15)
  modified_base (26)..(26)
gttgggagcaagcgcgctcccagctcgccccct

SEQ ID NO: 182 - DNA, 33 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctccctgctcgccccct

SEQ ID NO: 183 - DNA, 33 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcacgcgcgctcccagctcgccccct

SEQ ID NO: 184 - DNA, 35 bp, Artificial; identical to SEQ ID NO: 9
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide

SEQ ID NO: 185 - DNA, 36 bp, Artificial
  synthetic oligonucleotide
  modified_base (3)..(3): c or methylated C nucleotide
  modified_base (5)..(5): c or methylated C nucleotide
  modified_base (19)..(19): c or methylated C nucleotide
  modified_base (31)..(31): c or methylated C nucleotide
  modified_base (34)..(34): c or methylated C nucleotide
ttcgcgcaggcctgggtgcgtccctcctagcgccgg

SEQ ID NO: 186 - DNA, 37 bp, Artificial
  synthetic oligonucleotide
  modified_base (4)..(4): c or methylated C nucleotide
  modified_base (6)..(6): c or methylated C nucleotide
  modified_base (20)..(20): c or methylated C nucleotide
  modified_base (32)..(32): c or methylated C nucleotide
  modified_base (35)..(35): c or methylated C nucleotide
cttcgcgcaggcctgggtgcgtccctcctagcgccgg

SEQ ID NO: 187 - DNA, 38 bp, Artificial
  synthetic oligonucleotide
  modified_base (5)..(5): c or methylated C nucleotide
  modified_base (7)..(7): c or methylated C nucleotide
  modified_base (21)..(21): c or methylated C nucleotide
  modified_base (33)..(33): c or methylated C nucleotide
  modified_base (36)..(36): c or methylated C nucleotide
tcttcgcgcaggcctgggtgcgtccctcctagcgccgg

SEQ ID NO: 188 - DNA, 39 bp, Artificial
  synthetic oligonucleotide
  modified_base (6)..(6): c or methylated C nucleotide
  modified_base (8)..(8): c or methylated C nucleotide
  modified_base (22)..(22): c or methylated C nucleotide
  modified_base (34)..(34): c or methylated C nucleotide
  modified_base (37)..(37): c or methylated C nucleotide
ctcttcgcgcaggcctgggtgcgtccctcctagcgccgg

SEQ ID NO: 189 - DNA, 40 bp, Artificial
  synthetic oligonucleotide
  modified_base (7)..(7): c or methylated C nucleotide
  modified_base (9)..(9): c or methylated C nucleotide
  modified_base (23)..(23): c or methylated C nucleotide
  modified_base (35)..(35): c or methylated C nucleotide
  modified_base (38)..(38): c or methylated C nucleotide
tctcttcgcgcaggcctgggtgcgtccctcctagcgccgg

SEQ ID NO: 190 - DNA, 36 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccggg

SEQ ID NO: 191 - DNA, 37 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccggga

SEQ ID NO: 192 - DNA, 38 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgggaa

SEQ ID NO: 193 - DNA, 39 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgggaag

SEQ ID NO: 194 - DNA, 40 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgggaagc

SEQ ID NO: 195 - DNA, 37 bp, Artificial
  synthetic oligonucleotide
  modified_base (3)..(3): c or methylated C nucleotide
  modified_base (5)..(5): c or methylated C nucleotide
  modified_base (19)..(19): c or methylated C nucleotide
  modified_base (31)..(31): c or methylated C nucleotide
  modified_base (34)..(34): c or methylated C nucleotide
ttcgcgcaggcctgggtgcgtccctcctagcgccggg

SEQ ID NO: 196 - DNA, 39 bp, Artificial
  synthetic oligonucleotide
  modified_base (4)..(4): c or methylated C nucleotide
  modified_base (6)..(6): c or methylated C nucleotide
  modified_base (20)..(20): c or methylated C nucleotide
  modified_base (32)..(32): c or methylated C nucleotide
  modified_base (35)..(35): c or methylated C nucleotide
cttcgcgcaggcctgggtgcgtccctcctagcgccggga

SEQ ID NO: 197 - DNA, 41 bp, Artificial
  synthetic oligonucleotide
  modified_base (5)..(5): c or methylated C nucleotide
  modified_base (7)..(7): c or methylated C nucleotide
  modified_base (21)..(21): c or methylated C nucleotide
  modified_base (33)..(33): c or methylated C nucleotide
  modified_base (36)..(36): c or methylated C nucleotide
tcttcgcgcaggcctgggtgcgtccctcctagcgccgggaa

SEQ ID NO: 198 - DNA, 43 bp, Artificial
  synthetic oligonucleotide
  modified_base (6)..(6): c or methylated C nucleotide
  modified_base (8)..(8): c or methylated C nucleotide
  modified_base (22)..(22): c or methylated C nucleotide
  modified_base (34)..(34): c or methylated C nucleotide
  modified_base (37)..(37): c or methylated C nucleotide
ctcttcgcgcaggcctgggtgcgtccctcctagcgccgggaag

SEQ ID NO: 199 - DNA, 45 bp, Artificial
  synthetic oligonucleotide
  modified_base (7)..(7): c or methylated C nucleotide
  modified_base (9)..(9): c or methylated C nucleotide
  modified_base (23)..(23): c or methylated C nucleotide
  modified_base (35)..(35): c or methylated C nucleotide
  modified_base (38)..(38): c or methylated C nucleotide
tctcttcgcgcaggcctgggtgcgtccctcctagcgccgggaagc

SEQ ID NO: 200 - DNA, 35 bp, Artificial
  synthetic oligonucleotide
  modified_base (5)..(5): c or methylated C nucleotide
  modified_base (7)..(7): c or methylated C nucleotide
  modified_base (21)..(21): c or methylated C nucleotide
  modified_base (33)..(33): c or methylated C nucleotide
tcttcgcgcaggcctgggtgcgtccctcctagcgc

SEQ ID NO: 201 - DNA, 35 bp, Artificial
  synthetic oligonucleotide
  modified_base (8)..(8): c or methylated C nucleotide
  modified_base (10)..(10): c or methylated C nucleotide
  modified_base (24)..(24): c or methylated C nucleotide
ctctcttcgcgcaggcctgggtgcgtccctcctag

SEQ ID NO: 202 - DNA, 35 bp, Artificial
  synthetic oligonucleotide
  modified_base (11)..(11): c or methylated C nucleotide
  modified_base (13)..(13): c or methylated C nucleotide
  modified_base (27)..(27): c or methylated C nucleotide
tccctctcttcgcgcaggcctgggtgcgtccctcc

SEQ ID NO: 203 - DNA, 35 bp, Artificial
  synthetic oligonucleotide
  modified_base (14)..(14): c or methylated C nucleotide
  modified_base (16)..(16): c or methylated C nucleotide
  modified_base (30)..(30): c or methylated C nucleotide
ttctccctctcttcgcgcaggcctgggtgcgtccc

SEQ ID NO: 204 - DNA, 35 bp, Artificial
  synthetic oligonucleotide
  modified_base (17)..(17): c or methylated C nucleotide
  modified_base (19)..(19): c or methylated C nucleotide
  modified_base (33)..(33): c or methylated C nucleotide
actttctccctctcttcgcgcaggcctgggtgcgt

SEQ ID NO: 205 - DNA, 35 bp, Artificial
  synthetic oligonucleotide
  modified_base (1)..(1): c or methylated C nucleotide
  modified_base (15)..(15): c or methylated C nucleotide
  modified_base (27)..(27): c or methylated C nucleotide
  modified_base (30)..(30): c or methylated C nucleotide
cgcaggcctgggtgcgtccctcctagcgccgggaa

SEQ ID NO: 206 - DNA, 35 bp, Artificial; identical to SEQ ID NO: 33
  synthetic oligonucleotide
  modified_base (12)..(12): c or methylated C nucleotide
  modified_base (24)..(24): c or methylated C nucleotide
  modified_base (27)..(27): c or methylated C nucleotide

SEQ ID NO: 207 - DNA, 35 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
cctgggtgcgtccctcctagcgccgggaagctggg

SEQ ID NO: 208 - DNA, 35 bp, Artificial
  synthetic oligonucleotide
  modified_base (6)..(6): c or methylated C nucleotide
  modified_base (18)..(18): c or methylated C nucleotide
  modified_base (21)..(21): c or methylated C nucleotide
gggtgcgtccctcctagcgccgggaagctgggttg

SEQ ID NO: 209 - DNA, 35 bp, Artificial
  synthetic oligonucleotide
  modified_base (3)..(3): c or methylated C nucleotide
  modified_base (15)..(15): c or methylated C nucleotide
  modified_base (18)..(18): c or methylated C nucleotide
tgcgtccctcctagcgccgggaagctgggttgcct

SEQ ID NO: 210 - DNA, 33 bp, Artificial
  synthetic oligonucleotide
  modified_base (2)..(2): c or methylated C nucleotide
  modified_base (16)..(16): c or methylated C nucleotide
  modified_base (28)..(28): c or methylated C nucleotide
  modified_base (31)..(31): c or methylated C nucleotide
gcgcaggcctgggtgcgtccctcctagcgccgg

SEQ ID NO: 211 - DNA, 31 bp, Artificial
  synthetic oligonucleotide
  modified_base (14)..(14): c or methylated C nucleotide
  modified_base (26)..(26): c or methylated C nucleotide
  modified_base (29)..(29): c or methylated C nucleotide
gcaggcctgggtgcgtccctcctagcgccgg

SEQ ID NO: 212 - DNA, 29 bp, Artificial
  synthetic oligonucleotide
  modified_base (12)..(12): c or methylated C nucleotide
  modified_base (24)..(24): c or methylated C nucleotide
  modified_base (27)..(27): c or methylated C nucleotide
aggcctgggtgcgtccctcctagcgccgg

SEQ ID NO: 213 - DNA, 27 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgccgg

SEQ ID NO: 214 - DNA, 25 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
ctgggtgcgtccctcctagcgccgg

SEQ ID NO: 215 - DNA, 23 bp, Artificial
  synthetic oligonucleotide
  modified_base (6)..(6): c or methylated C nucleotide
  modified_base (18)..(18): c or methylated C nucleotide
  modified_base (21)..(21): c or methylated C nucleotide
gggtgcgtccctcctagcgccgg

SEQ ID NO: 216 - DNA, 21 bp, Artificial
  synthetic oligonucleotide
  modified_base (4)..(4): c or methylated C nucleotide
  modified_base (16)..(16): c or methylated C nucleotide
  modified_base (19)..(19): c or methylated C nucleotide
gtgcgtccctcctagcgccgg

SEQ ID NO: 217 - DNA, 19 bp, Artificial
  synthetic oligonucleotide
  modified_base (2)..(2): c or methylated C nucleotide
  modified_base (14)..(14): c or methylated C nucleotide
  modified_base (17)..(17): c or methylated C nucleotide
gcgtccctcctagcgccgg

SEQ ID NO: 218 - DNA, 17 bp, Artificial
  synthetic oligonucleotide
  modified_base (12)..(12): c or methylated C nucleotide
  modified_base (15)..(15): c or methylated C nucleotide
gtccctcctagcgccgg

SEQ ID NO: 219 - DNA, 15 bp, Artificial
  synthetic oligonucleotide
  modified_base (10)..(10): c or methylated C nucleotide
  modified_base (13)..(13): c or methylated C nucleotide
ccctcctagcgccgg

SEQ ID NO: 220 - DNA, 33 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgcc

SEQ ID NO: 221 - DNA, 31 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
tcgcgcaggcctgggtgcgtccctcctagcg

SEQ ID NO: 222 - DNA, 29 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccctcctag

SEQ ID NO: 223 - DNA, 27 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccctcct

SEQ ID NO: 224 - DNA, 25 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccctc

SEQ ID NO: 225 - DNA, 23 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccc

SEQ ID NO: 226 - DNA, 19 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tggcaggcctgggtgcgtc

SEQ ID NO: 227 - DNA, 19 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcg

SEQ ID NO: 228 - DNA, 17 bp, Artificial
  synthetic oligonucleotide
  modified_base (2)..(2): c or methylated C nucleotide
  modified_base (4)..(4): c or methylated C nucleotide
tcgcgcaggcctgggtg

SEQ ID NO: 229 - DNA, 15 bp, Artificial
  synthetic oligonucleotide
  modified_base (2)..(2): c or methylated C nucleotide
  modified_base (4)..(4): c or methylated C nucleotide
tcgcgcaggcctggg

SEQ ID NO: 230 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcacaggcctgggtgcgtccctcctagcgccgg

SEQ ID NO: 231 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgcccctcctagcgccgg

SEQ ID NO: 232 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctccgagcgccgg

SEQ ID NO: 233 - DNA, 34 bp, Artificial; identical to SEQ ID NO: 10
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide

SEQ ID NO: 234 - DNA, 35 bp, Artificial
  synthetic oligonucleotide
  modified_base (3)..(3): c or methylated C nucleotide
  modified_base (5)..(5): c or methylated C nucleotide
  modified_base (18)..(18): c or methylated C nucleotide
  modified_base (30)..(30): c or methylated C nucleotide
  modified_base (33)..(33): c or methylated C nucleotide
ttcgcgcaggcctgggtcgtccctcctagcgccgg

SEQ ID NO: 235 - DNA, 36 bp, Artificial
  synthetic oligonucleotide
  modified_base (4)..(4): c or methylated C nucleotide
  modified_base (6)..(6): c or methylated C nucleotide
  modified_base (19)..(19): c or methylated C nucleotide
  modified_base (31)..(31): c or methylated C nucleotide
  modified_base (34)..(34): c or methylated C nucleotide
cttcgcgcaggcctgggtcgtccctcctagcgccgg

SEQ ID NO: 236 - DNA, 37 bp, Artificial
  synthetic oligonucleotide
  modified_base (5)..(5): c or methylated C nucleotide
  modified_base (7)..(7): c or methylated C nucleotide
  modified_base (20)..(20): c or methylated C nucleotide
  modified_base (32)..(32): c or methylated C nucleotide
  modified_base (35)..(35): c or methylated C nucleotide
tcttcgcgcaggcctgggtcgtccctcctagcgccgg

SEQ ID NO: 237 - DNA, 38 bp, Artificial
  synthetic oligonucleotide
  modified_base (6)..(6): c or methylated C nucleotide
  modified_base (8)..(8): c or methylated C nucleotide
  modified_base (21)..(21): c or methylated C nucleotide
  modified_base (33)..(33): c or methylated C nucleotide
  modified_base (36)..(36): c or methylated C nucleotide
ctcttcgcgcaggcctgggtcgtccctcctagcgccgg

SEQ ID NO: 238 - DNA, 39 bp, Artificial
  synthetic oligonucleotide
  modified_base (7)..(7): c or methylated C nucleotide
  modified_base (9)..(9): c or methylated C nucleotide
  modified_base (22)..(22): c or methylated C nucleotide
  modified_base (34)..(34): c or methylated C nucleotide
  modified_base (37)..(37): c or methylated C nucleotide
tctcttcgcgcaggcctgggtcgtccctcctagcgccgg

SEQ ID NO: 239 - DNA, 35 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccggg

SEQ ID NO: 240 - DNA, 36 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccggga

SEQ ID NO: 241 - DNA, 37 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgggaa

SEQ ID NO: 242 - DNA, 38 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgggaag

SEQ ID NO: 243 - DNA, 39 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgggaagc

SEQ ID NO: 244 - DNA, 36 bp, Artificial
  synthetic oligonucleotide
  modified_base (3)..(3): c or methylated C nucleotide
  modified_base (5)..(5): c or methylated C nucleotide
  modified_base (18)..(18): c or methylated C nucleotide
  modified_base (30)..(30): c or methylated C nucleotide
  modified_base (33)..(33): c or methylated C nucleotide
ttcgcgcaggcctgggtcgtccctcctagcgccggg

SEQ ID NO: 245 - DNA, 38 bp, Artificial
  synthetic oligonucleotide
  modified_base (4)..(4): c or methylated C nucleotide
  modified_base (6)..(6): c or methylated C nucleotide
  modified_base (19)..(19): c or methylated C nucleotide
  modified_base (31)..(31): c or methylated C nucleotide
  modified_base (34)..(34): c or methylated C nucleotide
cttcgcgcaggcctgggtcgtccctcctagcgccggga

SEQ ID NO: 246 - DNA, 40 bp, Artificial
  synthetic oligonucleotide
  modified_base (5)..(5): c or methylated C nucleotide
  modified_base (7)..(7): c or methylated C nucleotide
  modified_base (20)..(20): c or methylated C nucleotide
  modified_base (32)..(32): c or methylated C nucleotide
  modified_base (35)..(35): c or methylated C nucleotide
tcttcgcgcaggcctgggtcgtccctcctagcgccgggaa

SEQ ID NO: 247 - DNA, 42 bp, Artificial
  synthetic oligonucleotide
  modified_base (6)..(6): c or methylated C nucleotide
  modified_base (8)..(8): c or methylated C nucleotide
  modified_base (21)..(21): c or methylated C nucleotide
  modified_base (33)..(33): c or methylated C nucleotide
  modified_base (36)..(36): c or methylated C nucleotide
ctcttcgcgcaggcctgggtcgtccctcctagcgccgggaag

SEQ ID NO: 248 - DNA, 44 bp, Artificial
  synthetic oligonucleotide
  modified_base (7)..(7): c or methylated C nucleotide
  modified_base (9)..(9): c or methylated C nucleotide
  modified_base (22)..(22): c or methylated C nucleotide
  modified_base (34)..(34): c or methylated C nucleotide
  modified_base (37)..(37): c or methylated C nucleotide
tctcttcgcgcaggcctgggtcgtccctcctagcgccgggaagc

SEQ ID NO: 249 - DNA, 34 bp, Artificial
  synthetic oligonucleotide
  modified_base (5)..(5): c or methylated C nucleotide
  modified_base (7)..(7): c or methylated C nucleotide
  modified_base (20)..(20): c or methylated C nucleotide
  modified_base (32)..(32): c or methylated C nucleotide
tcttcgcgcaggcctgggtcgtccctcctagcgc

SEQ ID NO: 250 - DNA, 34 bp, Artificial
  synthetic oligonucleotide
  modified_base (8)..(8): c or methylated C nucleotide
  modified_base (10)..(10): c or methylated C nucleotide
  modified_base (23)..(23): c or methylated C nucleotide
ctctcttcgcgcaggcctgggtcgtccctcctag

SEQ ID NO: 251 - DNA, 34 bp, Artificial
  synthetic oligonucleotide
  modified_base (11)..(11): c or methylated C nucleotide
  modified_base (13)..(13): c or methylated C nucleotide
  modified_base (26)..(26): c or methylated C nucleotide
tccctctcttcgcgcaggcctgggtcgtccctcc

SEQ ID NO: 252 - DNA, 34 bp, Artificial
  synthetic oligonucleotide
  modified_base (14)..(14): c or methylated C nucleotide
  modified_base (16)..(16): c or methylated C nucleotide
  modified_base (29)..(29): c or methylated C nucleotide
ttctccctctcttcgcgcaggcctgggtcgtccc

SEQ ID NO: 253 - DNA, 34 bp, Artificial
  synthetic oligonucleotide
  modified_base (17)..(17): c or methylated C nucleotide
  modified_base (19)..(19): c or methylated C nucleotide
  modified_base (32)..(32): c or methylated C nucleotide
actttctccctctcttcgcgcaggcctgggtcgt

SEQ ID NO: 254 - DNA, 34 bp, Artificial
  synthetic oligonucleotide
  modified_base (1)..(1): c or methylated C nucleotide
  modified_base (14)..(14): c or methylated C nucleotide
  modified_base (26)..(26): c or methylated C nucleotide
  modified_base (29)..(29): c or methylated C nucleotide
cgcaggcctgggtcgtccctcctagcgccgggaa

SEQ ID NO: 255 - DNA, 34 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
aggcctgggtcgtccctcctagcgccgggaagct

SEQ ID NO: 256 - DNA, 34 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
cctgggtcgtccctcctagcgccgggaagctggg

SEQ ID NO: 257 - DNA, 34 bp, Artificial
  synthetic oligonucleotide
  modified_base (5)..(5): c or methylated C nucleotide
  modified_base (17)..(17): c or methylated C nucleotide
  modified_base (20)..(20): c or methylated C nucleotide
gggtcgtccctcctagcgccgggaagctgggttg

SEQ ID NO: 258 - DNA, 34 bp, Artificial
  synthetic oligonucleotide
  modified_base (2)..(2): c or methylated C nucleotide
  modified_base (14)..(14): c or methylated C nucleotide
  modified_base (17)..(17): c or methylated C nucleotide
tcgtccctcctagcgccgggaagctgggttgcct

SEQ ID NO: 259 - DNA, 32 bp, Artificial
  synthetic oligonucleotide
  modified_base (2)..(2): c or methylated C nucleotide
  modified_base (15)..(15): c or methylated C nucleotide
  modified_base (27)..(27): c or methylated C nucleotide
  modified_base (30)..(30): c or methylated C nucleotide
gcgcaggcctgggtcgtccctcctagcgccgg

SEQ ID NO: 260 - DNA, 30 bp, Artificial
  synthetic oligonucleotide
  modified_base (13)..(13): c or methylated C nucleotide
  modified_base (25)..(25): c or methylated C nucleotide
  modified_base (28)..(28): c or methylated C nucleotide
gcaggcctgggtcgtccctcctagcgccgg

SEQ ID NO: 261 - DNA, 28 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
aggcctgggtcgtccctcctagcgccgg

SEQ ID NO: 262 - DNA, 26 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
gcctgggtcgtccctcctagcgccgg

SEQ ID NO: 263 - DNA, 24 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
ctgggtcgtccctcctagcgccgg

SEQ ID NO: 264 - DNA, 22 bp, Artificial
  synthetic oligonucleotide
  modified_base (5)..(5): c or methylated C nucleotide
  modified_base (17)..(17): c or methylated C nucleotide
  modified_base (20)..(20): c or methylated C nucleotide
gggtcgtccctcctagcgccgg

SEQ ID NO: 265 - DNA, 20 bp, Artificial
  synthetic oligonucleotide
  modified_base (3)..(3): c or methylated C nucleotide
  modified_base (15)..(15): c or methylated C nucleotide
  modified_base (18)..(18): c or methylated C nucleotide
gtcgtccctcctagcgccgg

SEQ ID NO: 266 - DNA, 18 bp, Artificial
  synthetic oligonucleotide
  modified_base (1)..(1): c or methylated C nucleotide
  modified_base (13)..(13): c or methylated C nucleotide
  modified_base (16)..(16): c or methylated C nucleotide
cgtccctcctagcgccgg

SEQ ID NO: 267 - DNA, 16 bp, Artificial
  synthetic oligonucleotide
  modified_base (11)..(11): c or methylated C nucleotide
  modified_base (14)..(14): c or methylated C nucleotide
tccctcctagcgccgg

SEQ ID NO: 268 - DNA, 15 bp, Artificial
  synthetic oligonucleotide
  modified_base (10)..(10): c or methylated C nucleotide
  modified_base (13)..(13): c or methylated C nucleotide
ccctcctagcgccgg

SEQ ID NO: 269 - DNA, 32 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgcc

SEQ ID NO: 270 - DNA, 30 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
tcgcgcaggcctgggtcgtccctcctagcg

SEQ ID NO: 271 - DNA, 28 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccctcctag

SEQ ID NO: 272 - DNA, 26 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccctcct

SEQ ID NO: 273 - DNA, 24 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccctc

SEQ ID NO: 274 - DNA, 22 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccc

SEQ ID NO: 275 - DNA, 20 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtc

SEQ ID NO: 276 - DNA, 18 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcg

SEQ ID NO: 277 - DNA, 16 bp, Artificial
  synthetic oligonucleotide
  modified_base (2)..(2): c or methylated C nucleotide
  modified_base (4)..(4): c or methylated C nucleotide
tcgcgcaggcctgggt

SEQ ID NO: 278 - DNA, 15 bp, Artificial
  synthetic oligonucleotide
  modified_base (2)..(2): c or methylated C nucleotide
  modified_base (4)..(4): c or methylated C nucleotide
tcgcgcaggcctggg

SEQ ID NO: 279 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcacaggcctgggtcgtccctcctagcgccgg

SEQ ID NO: 280 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgttcctcctagcgccgg

SEQ ID NO: 281 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctccgagcgccgg

SEQ ID NO: 282 - DNA, 719 bp, Homo sapiens
cctgagggtggcggggtgctcttcgcagcttctctgtggagaccggtcagcggggcggcgtggccgctcgcggcgtctccctggtggcatccgcacagcccgccgcggtccggtcccgctccgggtcagaattggcggctgcggggacagccttgcggctaggcagggggcgggccgccgcgtgggtccggcagtccctcctcccgccaaggcgccgcccagacccgctctccagccggcccggctcgccaccctagaccgccccagccaccccttcctccgccggcccggcccccgctcctcccccgccggcccggcccggccccctccttctccccgccggcgctcgctgcctccccctcttccctcttcccacaccgccctcagccgctccctctcgtacgcccgtctgaagaagaatcgagcgcggaacgcatcgatagctctgccctctgcggccgcccggccccgaactcatcggtgtgctcggagctcgattttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggtacggagcggaccacccctcctgggcccctgcccggg

SEQ ID NO: 283 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcgg

SEQ ID NO: 284 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgcc

SEQ ID NO: 285 - DNA, 23 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (13)..(13): c or methylated C nucleotide
  modified_base (17)..(17): c or methylated C nucleotide
  modified_base (20)..(20): c or methylated C nucleotide
cctccgccgccgcggccgccgcc

SEQ ID NO: 286 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgct

SEQ ID NO: 287 - DNA, 27 bp, Artificial
  synthetic oligonucleotide
  modified_base (2)..(2): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (25)..(25): c or methylated C nucleotide
ccgagccgccgccaccttcgccgccgc

SEQ ID NO: 288 - DNA, 25 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (11)..(11): c or methylated C nucleotide
  modified_base (22)..(22): c or methylated C nucleotide
tgcgcgcgctcgctcccagtccgaa

SEQ ID NO: 289 - DNA, 28 bp, Artificial
  synthetic oligonucleotide
gcggccacgccgccccgctgaccggtct

SEQ ID NO: 290 - DNA, 29 bp, Artificial
  synthetic oligonucleotide
ccacagagaagctgcgaagagcaccccgc

SEQ ID NO: 291 - DNA, 34 bp, Artificial
  synthetic oligonucleotide
gcgggctgtgcggatgccacagggagacgccgcg

SEQ ID NO: 292 - DNA, 26 bp, Artificial
  synthetic oligonucleotide
gccgcaaggctgtccccgcagccgcc

SEQ ID NO: 293 - DNA, 25 bp, Artificial
  synthetic oligonucleotide
gcgggtctgggcggcgccttggcgg

SEQ ID NO: 294 - DNA, 27 bp, Artificial
  synthetic oligonucleotide
cggtctagggtggcgagccgggccggc

SEQ ID NO: 295 - DNA, 33 bp, Artificial
  synthetic oligonucleotide
gccggcgggggaggagcgggggccgggccggcg

SEQ ID NO: 296 - DNA, 37 bp, Artificial
  synthetic oligonucleotide
gcgagcgccggcggggagaaggagggggccgggccgg

SEQ ID NO: 297 - DNA, 23 bp, Artificial
  synthetic oligonucleotide
gctatcgatgcgttccgcgctcg

SEQ ID NO: 298 - DNA, 42 bp, Artificial
  synthetic oligonucleotide
cgagctccgagcacaccgatgagttcggggccgggcggccgc

SEQ ID NO: 299 - DNA, 33 bp, Artificial
  synthetic oligonucleotide
gacgggcgtacgagagggagcggctgagggcgg

SEQ ID NO: 300 - DNA, 31 bp, Artificial
  synthetic oligonucleotide
ccgctgagcctctggccccgccgccgccttc

SEQ ID NO: 301 - DNA, 21 bp, Artificial
  synthetic oligonucleotide
cgctccgtacctctctcccgc

SEQ ID NO: 302 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcgg

SEQ ID NO: 303 - DNA, 24 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (20)..(20): c or methylated C nucleotide
  modified_base (22)..(22): c or methylated C nucleotide
acccggagcgggaccggaccgcgg

SEQ ID NO: 304 - DNA, 25 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (21)..(21): c or methylated C nucleotide
  modified_base (23)..(23): c or methylated C nucleotide
gacccggagcgggaccggaccgcgg

SEQ ID NO: 305 - DNA, 26 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (22)..(22): c or methylated C nucleotide
  modified_base (24)..(24): c or methylated C nucleotide
tgacccggagcgggaccggaccgcgg

SEQ ID NO: 306 - DNA, 27 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (23)..(23): c or methylated C nucleotide
  modified_base (25)..(25): c or methylated C nucleotide
ctgacccggagcgggaccggaccgcgg

SEQ ID NO: 307 - DNA, 28 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (24)..(24): c or methylated C nucleotide
  modified_base (26)..(26): c or methylated C nucleotide
tctgacccggagcgggaccggaccgcgg

SEQ ID NO: 308 - DNA, 24 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggc

SEQ ID NO: 309 - DNA, 25 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcg

SEQ ID NO: 310 - DNA, 26 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcgg

SEQ ID NO: 311 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcggg

SEQ ID NO: 312 - DNA, 28 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcgggc

SEQ ID NO: 313 - DNA, 25 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (20)..(20): c or methylated C nucleotide
  modified_base (22)..(22): c or methylated C nucleotide
acccggagcgggaccggaccgcggc

SEQ ID NO: 314 - DNA, 27 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (21)..(21): c or methylated C nucleotide
  modified_base (23)..(23): c or methylated C nucleotide
gacccggagcgggaccggaccgcggcg

SEQ ID NO: 315 - DNA, 29 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (22)..(22): c or methylated C nucleotide
  modified_base (24)..(24): c or methylated C nucleotide
tgacccggagcgggaccggaccgcggcgg

SEQ ID NO: 316 - DNA, 31 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (23)..(23): c or methylated C nucleotide
  modified_base (25)..(25): c or methylated C nucleotide
ctgacccggagcgggaccggaccgcggcggg

SEQ ID NO: 317 - DNA, 33 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (24)..(24): c or methylated C nucleotide
  modified_base (26)..(26): c or methylated C nucleotide
tctgacccggagcgggaccggaccgcggcgggc

SEQ ID NO: 318 - DNA, 23 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (22)..(22): c or methylated C nucleotide
tgacccggagcgggaccggaccg

SEQ ID NO: 319 - DNA, 23 bp, Artificial
  synthetic oligonucleotide
  modified_base (9)..(9): c or methylated C nucleotide
  modified_base (14)..(14): c or methylated C nucleotide
  modified_base (20)..(20): c or methylated C nucleotide
ttctgacccggagcgggaccgga

SEQ ID NO: 320 - DNA, 23 bp, Artificial
  synthetic oligonucleotide
  modified_base (12)..(12): c or methylated C nucleotide
  modified_base (17)..(17): c or methylated C nucleotide
  modified_base (23)..(23): c or methylated C nucleotide
caattctgacccggagcgggacc

SEQ ID NO: 321 - DNA, 23 bp, Artificial
  synthetic oligonucleotide
  modified_base (15)..(15): c or methylated C nucleotide
  modified_base (20)..(20): c or methylated C nucleotide
cgccaattctgacccggagcggg

SEQ ID NO: 322 - DNA, 23 bp, Artificial
  synthetic oligonucleotide
  modified_base (18)..(18): c or methylated C nucleotide
  modified_base (23)..(23): c or methylated C nucleotide
agccgccaattctgacccggagc

SEQ ID NO: 323 - DNA, 23 bp, Artificial
  synthetic oligonucleotide
  modified_base (5)..(5): c or methylated C nucleotide
  modified_base (11)..(11): c or methylated C nucleotide
  modified_base (16)..(16): c or methylated C nucleotide
  modified_base (18)..(18): c or methylated C nucleotide
ggagcgggaccggaccgcggcgg

SEQ ID NO: 324 - DNA, 23 bp, Artificial
  synthetic oligonucleotide
  modified_base (2)..(2): c or methylated C nucleotide
  modified_base (8)..(8): c or methylated C nucleotide
  modified_base (13)..(13): c or methylated C nucleotide
  modified_base (15)..(15): c or methylated C nucleotide
gcgggaccggaccgcggcgggct

SEQ ID NO: 325 - DNA, 23 bp, Artificial
  synthetic oligonucleotide
  modified_base (5)..(5): c or methylated C nucleotide
  modified_base (10)..(10): c or methylated C nucleotide
  modified_base (12)..(12): c or methylated C nucleotide
ggaccggaccgcggcgggctgtg

SEQ ID NO: 326 - DNA, 23 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
ccggaccgcggcgggctgtgcgg

SEQ ID NO: 327 - DNA, 23 bp, Artificial
  synthetic oligonucleotide
  modified_base (4)..(4): c or methylated C nucleotide
  modified_base (6)..(6): c or methylated C nucleotide
gaccgcggcgggctgtgcggatg

SEQ ID NO: 328 - DNA, 21 bp, Artificial
  synthetic oligonucleotide
  modified_base (1)..(1): c or methylated C nucleotide
  modified_base (6)..(6): c or methylated C nucleotide
  modified_base (12)..(12): c or methylated C nucleotide
  modified_base (17)..(17): c or methylated C nucleotide
  modified_base (19)..(19): c or methylated C nucleotide
cggagcgggaccggaccgcgg

SEQ ID NO: 329 - DNA, 19 bp, Artificial
  synthetic oligonucleotide
  modified_base (4)..(4): c or methylated C nucleotide
  modified_base (10)..(10): c or methylated C nucleotide
  modified_base (15)..(15): c or methylated C nucleotide
  modified_base (17)..(17): c or methylated C nucleotide
gagcgggaccggaccgcgg

SEQ ID NO: 330 - DNA, 17 bp, Artificial
  synthetic oligonucleotide
  modified_base (2)..(2): c or methylated C nucleotide
  modified_base (8)..(8): c or methylated C nucleotide
  modified_base (13)..(13): c or methylated C nucleotide
  modified_base (15)..(15): c or methylated C nucleotide
gcgggaccggaccgcgg

SEQ ID NO: 331 - DNA, 15 bp, Artificial
  synthetic oligonucleotide
  modified_base (6)..(6): c or methylated C nucleotide
  modified_base (11)..(11): c or methylated C nucleotide
  modified_base (13)..(13): c or methylated C nucleotide
gggaccggaccgcgg

SEQ ID NO: 332 - DNA, 21 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgc

SEQ ID NO: 333 - DNA, 19 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
cccggagcgggaccggacc

SEQ ID NO: 334 - DNA, 17 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
cccggagcgggaccgga

SEQ ID NO: 335 - DNA, 15 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
cccggagcgggaccg

SEQ ID NO: 336 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagccggaccggaccgcgg

SEQ ID NO: 337 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccacgg

SEQ ID NO: 338 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
ccctgagcgggaccggaccgcgg

SEQ ID NO: 339 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgcc

SEQ ID NO: 340 - DNA, 25 bp, Artificial
  synthetic oligonucleotide
  modified_base (4)..(4): c or methylated C nucleotide
  modified_base (12)..(12): c or methylated C nucleotide
  modified_base (14)..(14): c or methylated C nucleotide
  modified_base (17)..(17): c or methylated C nucleotide
  modified_base (22)..(22): c or methylated C nucleotide
tgccggacccacgcggcggcccgcc

SEQ ID NO: 341 - DNA, 26 bp, Artificial
  synthetic oligonucleotide
  modified_base (5)..(5): c or methylated C nucleotide
  modified_base (13)..(13): c or methylated C nucleotide
  modified_base (15)..(15): c or methylated C nucleotide
  modified_base (18)..(18): c or methylated C nucleotide
  modified_base (23)..(23): c or methylated C nucleotide
ctgccggacccacgcggcggcccgcc

SEQ ID NO: 342 - DNA, 27 bp, Artificial
  synthetic oligonucleotide
  modified_base (6)..(6): c or methylated C nucleotide
  modified_base (14)..(14): c or methylated C nucleotide
  modified_base (16)..(16): c or methylated C nucleotide
  modified_base (19)..(19): c or methylated C nucleotide
  modified_base (24)..(24): c or methylated C nucleotide
actgccggacccacgcggcggcccgcc

SEQ ID NO: 343 - DNA, 28 bp, Artificial
  synthetic oligonucleotide
  modified_base (7)..(7): c or methylated C nucleotide
  modified_base (15)..(15): c or methylated C nucleotide
  modified_base (17)..(17): c or methylated C nucleotide
  modified_base (20)..(20): c or methylated C nucleotide
  modified_base (25)..(25): c or methylated C nucleotide
gactgccggacccacgcggcggcccgcc

SEQ ID NO: 344 - DNA, 29 bp, Artificial
  synthetic oligonucleotide
  modified_base (8)..(8): c or methylated C nucleotide
  modified_base (16)..(16): c or methylated C nucleotide
  modified_base (18)..(18): c or methylated C nucleotide
  modified_base (21)..(21): c or methylated C nucleotide
  modified_base (26)..(26): c or methylated C nucleotide
ggactgccggacccacgcggcggcccgcc

SEQ ID NO: 345 - DNA, 25 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccc

SEQ ID NO: 346 - DNA, 26 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgcccc

SEQ ID NO: 347 - DNA, 27 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccccc

SEQ ID NO: 348 - DNA, 28 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccccct

SEQ ID NO: 349 - DNA, 29 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccccctg

SEQ ID NO: 350 - DNA, 26 bp, Artificial
  synthetic oligonucleotide
  modified_base (4)..(4): c or methylated C nucleotide
  modified_base (12)..(12): c or methylated C nucleotide
  modified_base (14)..(14): c or methylated C nucleotide
  modified_base (17)..(17): c or methylated C nucleotide
  modified_base (22)..(22): c or methylated C nucleotide
tgccggacccacgcggcggcccgccc

SEQ ID NO: 351 - DNA, 28 bp, Artificial
  synthetic oligonucleotide
  modified_base (5)..(5): c or methylated C nucleotide
  modified_base (13)..(13): c or methylated C nucleotide
  modified_base (15)..(15): c or methylated C nucleotide
  modified_base (18)..(18): c or methylated C nucleotide
  modified_base (23)..(23): c or methylated C nucleotide
ctgccggacccacgcggcggcccgcccc

SEQ ID NO: 352 - DNA, 30 bp, Artificial
  synthetic oligonucleotide
  modified_base (6)..(6): c or methylated C nucleotide
  modified_base (14)..(14): c or methylated C nucleotide
  modified_base (16)..(16): c or methylated C nucleotide
  modified_base (19)..(19): c or methylated C nucleotide
  modified_base (24)..(24): c or methylated C nucleotide
actgccggacccacgcggcggcccgccccc

SEQ ID NO: 353 - DNA, 32 bp, Artificial
  synthetic oligonucleotide
  modified_base (7)..(7): c or methylated C nucleotide
  modified_base (15)..(15): c or methylated C nucleotide
  modified_base (17)..(17): c or methylated C nucleotide
  modified_base (20)..(20): c or methylated C nucleotide
  modified_base (25)..(25): c or methylated C nucleotide
gactgccggacccacgcggcggcccgccccct

SEQ ID NO: 354 - DNA, 34 bp, Artificial
  synthetic oligonucleotide
  modified_base (8)..(8): c or methylated C nucleotide
  modified_base (16)..(16): c or methylated C nucleotide
  modified_base (18)..(18): c or methylated C nucleotide
  modified_base (21)..(21): c or methylated C nucleotide
  modified_base (26)..(26): c or methylated C nucleotide
ggactgccggacccacgcggcggcccgccccctg

SEQ ID NO: 355 - DNA, 24 bp, Artificial
  synthetic oligonucleotide
  modified_base (6)..(6): c or methylated C nucleotide
  modified_base (14)..(14): c or methylated C nucleotide
  modified_base (16)..(16): c or methylated C nucleotide
  modified_base (19)..(19): c or methylated C nucleotide
  modified_base (24)..(24): c or methylated C nucleotide
actgccggacccacgcggcggccc

SEQ ID NO: 356 - DNA, 24 bp, Artificial
  synthetic oligonucleotide
  modified_base (9)..(9): c or methylated C nucleotide
  modified_base (17)..(17): c or methylated C nucleotide
  modified_base (19)..(19): c or methylated C nucleotide
  modified_base (22)..(22): c or methylated C nucleotide
gggactgccggacccacgcggcgg

SEQ ID NO: 357 - DNA, 24 bp, Artificial
  synthetic oligonucleotide
  modified_base (12)..(12): c or methylated C nucleotide
  modified_base (20)..(20): c or methylated C nucleotide
  modified_base (22)..(22): c or methylated C nucleotide
ggagggactgccggacccacgcgg

SEQ ID NO: 358 - DNA, 24 bp, Artificial
  synthetic oligonucleotide
  modified_base (15)..(15): c or methylated C nucleotide
  modified_base (23)..(23): c or methylated C nucleotide
ggaggagggactgccggacccacg

SEQ ID NO: 359 - DNA, 24 bp, Artificial
  synthetic oligonucleotide
  modified_base (18)..(18): c or methylated C nucleotide
gcgggaggagggactgccggaccc

SEQ ID NO: 360 - DNA, 24 bp, Artificial
  synthetic oligonucleotide
  modified_base (8)..(8): c or methylated C nucleotide
  modified_base (10)..(10): c or methylated C nucleotide
  modified_base (13)..(13): c or methylated C nucleotide
  modified_base (18)..(18): c or methylated C nucleotide
ggacccacgcggcggcccgccccc

SEQ ID NO: 361 - DNA, 24 bp, Artificial
  synthetic oligonucleotide
  modified_base (5)..(5): c or methylated C nucleotide
  modified_base (7)..(7): c or methylated C nucleotide
  modified_base (10)..(10): c or methylated C nucleotide
  modified_base (15)..(15): c or methylated C nucleotide
cccacgcggcggcccgccccctgc

SEQ ID NO: 362 - DNA, 24 bp, Artificial
  synthetic oligonucleotide
  modified_base (2)..(2): c or methylated C nucleotide
  modified_base (4)..(4): c or methylated C nucleotide
  modified_base (7)..(7): c or methylated C nucleotide
  modified_base (12)..(12): c or methylated C nucleotide
acgcggcggcccgccccctgccta

SEQ ID NO: 363 - DNA, 24 bp, Artificial
  synthetic oligonucleotide
  modified_base (1)..(1): c or methylated C nucleotide
  modified_base (4)..(4): c or methylated C nucleotide
  modified_base (9)..(9): c or methylated C nucleotide
cggcggcccgccccctgcctagcc

SEQ ID NO: 364 - DNA, 24 bp, Artificial
  synthetic oligonucleotide
  modified_base (1)..(1): c or methylated C nucleotide
  modified_base (6)..(6): c or methylated C nucleotide
cggcccgccccctgcctagccgca

SEQ ID NO: 365 - DNA, 22 bp, Artificial
  synthetic oligonucleotide
  modified_base (1)..(1): c or methylated C nucleotide
  modified_base (9)..(9): c or methylated C nucleotide
  modified_base (11)..(11): c or methylated C nucleotide
  modified_base (14)..(14): c or methylated C nucleotide
  modified_base (19)..(19): c or methylated C nucleotide
cggacccacgcggcggcccgcc

SEQ ID NO: 366 - DNA, 20 bp, Artificial
  synthetic oligonucleotide
  modified_base (7)..(7): c or methylated C nucleotide
  modified_base (9)..(9): c or methylated C nucleotide
  modified_base (12)..(12): c or methylated C nucleotide
  modified_base (17)..(17): c or methylated C nucleotide
gacccacgcggcggcccgcc

SEQ ID NO: 367 - DNA, 18 bp, Artificial
  synthetic oligonucleotide
  modified_base (5)..(5): c or methylated C nucleotide
  modified_base (7)..(7): c or methylated C nucleotide
  modified_base (10)..(10): c or methylated C nucleotide
  modified_base (15)..(15): c or methylated C nucleotide
cccacgcggcggcccgcc

SEQ ID NO: 368 - DNA, 16 bp, Artificial
  synthetic oligonucleotide
  modified_base (3)..(3): c or methylated C nucleotide
  modified_base (5)..(5): c or methylated C nucleotide
  modified_base (8)..(8): c or methylated C nucleotide
  modified_base (13)..(13): c or methylated C nucleotide
cacgcggcggcccgcc

SEQ ID NO: 369 - DNA, 15 bp, Artificial
  synthetic oligonucleotide
  modified_base (2)..(2): c or methylated C nucleotide
  modified_base (4)..(4): c or methylated C nucleotide
  modified_base (7)..(7): c or methylated C nucleotide
  modified_base (12)..(12): c or methylated C nucleotide
acgcggcggcccgcc

SEQ ID NO: 370 - DNA, 22 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccg

SEQ ID NO: 371 - DNA, 20 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
gccggacccacgcggcggcc

SEQ ID NO: 372 - DNA, 18 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
gccggacccacgcggcgg

SEQ ID NO: 373 - DNA, 16 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
gccggacccacgcggc

SEQ ID NO: 374 - DNA, 15 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
gccggacccacgcgg

SEQ ID NO: 375 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccgggcccacgcggcggcccgcc

SEQ ID NO: 376 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgctgcggcccgcc

SEQ ID NO: 377 - DNA, 24 bp, Artificial
  synthetic oligonucleotide
  modified_base (3)..(3): synthetic oligonucleotide
  modified_base (11)..(11): synthetic oligonucleotide
  modified_base (13)..(13): synthetic oligonucleotide
  modified_base (16)..(16): synthetic oligonucleotide
  modified_base (21)..(21): synthetic oligonucleotide
gccggacccacgcggcggtccgcc

SEQ ID NO: 378 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgct

SEQ ID NO: 379 - DNA, 28 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (25)..(25): c or methylated C nucleotide
cttcgccgccgccactgccgccgccgct

SEQ ID NO: 380 - DNA, 29 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (26)..(26): c or methylated C nucleotide
ccttcgccgccgccactgccgccgccgct

SEQ ID NO: 381 - DNA, 30 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (27)..(27): c or methylated C nucleotide
accttcgccgccgccactgccgccgccgct

SEQ ID NO: 382 - DNA, 31 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (28)..(28): c or methylated C nucleotide
caccttcgccgccgccactgccgccgccgct

SEQ ID NO: 383 - DNA, 32 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (29)..(29): c or methylated C nucleotide
ccaccttcgccgccgccactgccgccgccgct

SEQ ID NO: 384 - DNA, 28 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctg

SEQ ID NO: 385 - DNA, 29 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgc

SEQ ID NO: 386 - DNA, 30 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgct

SEQ ID NO: 387 - DNA, 31 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgctg

SEQ ID NO: 388 - DNA, 32 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgctgc

SEQ ID NO: 389 - DNA, 29 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (25)..(25): c or methylated C nucleotide
cttcgccgccgccactgccgccgccgctg

SEQ ID NO: 390 - DNA, 31 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (26)..(26): c or methylated C nucleotide
ccttcgccgccgccactgccgccgccgctgc

SEQ ID NO: 391 - DNA, 33 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (27)..(27): c or methylated C nucleotide
accttcgccgccgccactgccgccgccgctgct

SEQ ID NO: 392 - DNA, 35 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (28)..(28): c or methylated C nucleotide
caccttcgccgccgccactgccgccgccgctgctg

SEQ ID NO: 393 - DNA, 37 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (29)..(29): c or methylated C nucleotide
ccaccttcgccgccgccactgccgccgccgctgctgc

SEQ ID NO: 394 - DNA, 27 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (27)..(27): c or methylated C nucleotide
accttcgccgccgccactgccgccgcc

SEQ ID NO: 395 - DNA, 27 bp, Artificial
  synthetic oligonucleotide
  modified_base (9)..(9): c or methylated C nucleotide
  modified_base (12)..(12): c or methylated C nucleotide
  modified_base (15)..(15): c or methylated C nucleotide
  modified_base (24)..(24): c or methylated C nucleotide
  modified_base (27)..(27): c or methylated C nucleotide
gccaccttcgccgccgccactgccgcc

SEQ ID NO: 396 - DNA, 27 bp, Artificial
  synthetic oligonucleotide
  modified_base (12)..(12): c or methylated C nucleotide
  modified_base (15)..(15): c or methylated C nucleotide
  modified_base (18)..(18): c or methylated C nucleotide
  modified_base (27)..(27): c or methylated C nucleotide
gccgccaccttcgccgccgccactgcc

SEQ ID NO: 397 - DNA, 27 bp, Artificial
  synthetic oligonucleotide
  modified_base (15)..(15): c or methylated C nucleotide
  modified_base (18)..(18): c or methylated C nucleotide
  modified_base (21)..(21): c or methylated C nucleotide
gccgccgccaccttcgccgccgccact

SEQ ID NO: 398 - DNA, 27 bp, Artificial
  synthetic oligonucleotide
  modified_base (18)..(18): c or methylated C nucleotide
  modified_base (21)..(21): c or methylated C nucleotide
  modified_base (24)..(24): c or methylated C nucleotide
cgagccgccgccaccttcgccgccgcc

SEQ ID NO: 399 - DNA, 27 bp, Artificial
  synthetic oligonucleotide
  modified_base (3)..(3): c or methylated C nucleotide
  modified_base (6)..(6): c or methylated C nucleotide
  modified_base (15)..(15): c or methylated C nucleotide
  modified_base (18)..(18): c or methylated C nucleotide
  modified_base (21)..(21): c or methylated C nucleotide
gccgccgccactgccgccgccgctgct

SEQ ID NO: 400 - DNA, 27 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (18)..(18): c or methylated C nucleotide
gccgccactgccgccgccgctgctgcc

SEQ ID NO: 401 - DNA, 27 bp, Artificial
  synthetic oligonucleotide
  modified_base (9)..(9): c or methylated C nucleotide
  modified_base (12)..(12): c or methylated C nucleotide
  modified_base (15)..(15): c or methylated C nucleotide
gccactgccgccgccgctgctgcctcc

SEQ ID NO: 402 - DNA, 27 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
actgccgccgccgctgctgcctccgcc

SEQ ID NO: 403 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
gccgccgccgctgctgcctccgccgcc

SEQ ID NO: 404 - DNA, 25 bp, Artificial
  synthetic oligonucleotide
  modified_base (1)..(1): c or methylated C nucleotide
  modified_base (4)..(4): c or methylated C nucleotide
  modified_base (7)..(7): c or methylated C nucleotide
  modified_base (16)..(16): c or methylated C nucleotide
  modified_base (19)..(19): c or methylated C nucleotide
  modified_base (22)..(22): c or methylated C nucleotide
cgccgccgccactgccgccgccgct

SEQ ID NO: 405 - DNA, 23 bp, Artificial
  synthetic oligonucleotide
  modified_base (2)..(2): c or methylated C nucleotide
  modified_base (5)..(5): c or methylated C nucleotide
  modified_base (14)..(14): c or methylated C nucleotide
  modified_base (17)..(17): c or methylated C nucleotide
  modified_base (20)..(20): c or methylated C nucleotide
ccgccgccactgccgccgccgct

SEQ ID NO: 406 - DNA, 21 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (18)..(18): c or methylated C nucleotide
gccgccactgccgccgccgct

SEQ ID NO: 407 - DNA, 19 bp, Artificial
  synthetic oligonucleotide
  modified_base (1)..(1): c or methylated C nucleotide
  modified_base (10)..(10): c or methylated C nucleotide
  modified_base (13)..(13): c or methylated C nucleotide
  modified_base (16)..(16): c or methylated C nucleotide
cgccactgccgccgccgct

SEQ ID NO: 408 - DNA, 17 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
ccactgccgccgccgct

SEQ ID NO: 409 - DNA, 15 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
actgccgccgccgct

SEQ ID NO: 410 - DNA, 25 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccg

SEQ ID NO: 411 - DNA, 23 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ttcgccgccgccactgccgccgc

SEQ ID NO: 412 - DNA, 21 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ttcgccgccgccactgccgcc

SEQ ID NO: 413 - DNA, 19 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
ttcgccgccgccactgccg

SEQ ID NO: 414 - DNA, 17 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
ttcgccgccgccactgc

SEQ ID NO: 415 - DNA, 15 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
ttcgccgccgccact

SEQ ID NO: 416 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcaccgccgccactgccgccgccgct

SEQ ID NO: 417 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactcccgccgccgct

SEQ ID NO: 418 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgtcactgccgccgccgct

SEQ ID NO: 419 - DNA, 28 bp, Artificial
  synthetic oligonucleotide
gcggccacgccgccccgctgaccggtct

SEQ ID NO: 420 - DNA, 29 bp, Artificial
  synthetic oligonucleotide
agcggccacgccgccccgctgaccggtct

SEQ ID NO: 421 - DNA, 30 bp, Artificial
  synthetic oligonucleotide
gagcggccacgccgccccgctgaccggtct

SEQ ID NO: 422 - DNA, 31 bp, Artificial
  synthetic oligonucleotide
cgagcggccacgccgccccgctgaccggtct

SEQ ID NO: 423 - DNA, 32 bp, Artificial
  synthetic oligonucleotide
gcgagcggccacgccgccccgctgaccggtct

SEQ ID NO: 424 - DNA, 33 bp, Artificial
  synthetic oligonucleotide
cgcgagcggccacgccgccccgctgaccggtct

SEQ ID NO: 425 - DNA, 29 bp, Artificial
  synthetic oligonucleotide
gcggccacgccgccccgctgaccggtctc

SEQ ID NO: 426 - DNA, 30 bp, Artificial
  synthetic oligonucleotide
gcggccacgccgccccgctgaccggtctcc

SEQ ID NO: 427 - DNA, 31 bp, Artificial
  synthetic oligonucleotide
gcggccacgccgccccgctgaccggtctcca

SEQ ID NO: 428 - DNA, 32 bp, Artificial
  synthetic oligonucleotide
gcggccacgccgccccgctgaccggtctccac

SEQ ID NO: 429 - DNA, 33 bp, Artificial
  synthetic oligonucleotide
gcggccacgccgccccgctgaccggtctccaca

SEQ ID NO: 430 - DNA, 30 bp, Artificial
  synthetic oligonucleotide
agcggccacgccgccccgctgaccggtctc

SEQ ID NO: 431 - DNA, 32 bp, Artificial
  synthetic oligonucleotide
gagcggccacgccgccccgctgaccggtctcc

SEQ ID NO: 432 - DNA, 34 bp, Artificial
  synthetic oligonucleotide
cgagcggccacgccgccccgctgaccggtctcca

SEQ ID NO: 433 - DNA, 36 bp, Artificial
  synthetic oligonucleotide
gcgagcggccacgccgccccgctgaccggtctccac

SEQ ID NO: 434 - DNA, 38 bp, Artificial
  synthetic oligonucleotide
cgcgagcggccacgccgccccgctgaccggtctccaca

SEQ ID NO: 435 - DNA, 28 bp, Artificial
  synthetic oligonucleotide
cgagcggccacgccgccccgctgaccgg

SEQ ID NO: 436 - DNA, 28 bp, Artificial
  synthetic oligonucleotide
ccgcgagcggccacgccgccccgctgac

SEQ ID NO: 437 - DNA, 28 bp, Artificial
  synthetic oligonucleotide
acgccgcgagcggccacgccgccccgct

SEQ ID NO: 438 - DNA, 28 bp, Artificial
  synthetic oligonucleotide
gagacgccgcgagcggccacgccgcccc

SEQ ID NO: 439 - DNA, 28 bp, Artificial
  synthetic oligonucleotide
agggagacgccgcgagcggccacgccgc

SEQ ID NO: 440 - DNA, 28 bp, Artificial
  synthetic oligonucleotide
gccacgccgccccgctgaccggtctcca

SEQ ID NO: 441 - DNA, 28 bp, Artificial
  synthetic oligonucleotide
acgccgccccgctgaccggtctccacag

SEQ ID NO: 442 - DNA, 28 bp, Artificial
  synthetic oligonucleotide
ccgccccgctgaccggtctccacagaga

SEQ ID NO: 443 - DNA, 28 bp, Artificial
  synthetic oligonucleotide
ccccgctgaccggtctccacagagaagc

SEQ ID NO: 444 - DNA, 28 bp, Artificial
  synthetic oligonucleotide
cgctgaccggtctccacagagaagctgc

SEQ ID NO: 445 - DNA, 26 bp, Artificial
  synthetic oligonucleotide
ggccacgccgccccgctgaccggtct

SEQ ID NO: 446 - DNA, 24 bp, Artificial
  synthetic oligonucleotide
ccacgccgccccgctgaccggtct

SEQ ID NO: 447 - DNA, 22 bp, Artificial
  synthetic oligonucleotide
acgccgccccgctgaccggtct

SEQ ID NO: 448 - DNA, 20 bp, Artificial
  synthetic oligonucleotide
gccgccccgctgaccggtct

SEQ ID NO: 449 - DNA, 18 bp, Artificial
  synthetic oligonucleotide
cgccccgctgaccggtct

SEQ ID NO: 450 - DNA, 16 bp, Artificial
  synthetic oligonucleotide
ccccgctgaccggtct

SEQ ID NO: 451 - DNA, 15 bp, Artificial
  synthetic oligonucleotide
cccgctgaccggtct

SEQ ID NO: 452 - DNA, 26 bp, Artificial
  synthetic oligonucleotide
gcggccacgccgccccgctgaccggt

SEQ ID NO: 453 - DNA, 24 bp, Artificial
  synthetic oligonucleotide
gcggccacgccgccccgctgaccg

SEQ ID NO: 454 - DNA, 22 bp, Artificial
  synthetic oligonucleotide
gcggccacgccgccccgctgac

SEQ ID NO: 455 - DNA, 20 bp, Artificial
  synthetic oligonucleotide
gcggccacgccgccccgctg

SEQ ID NO: 456 - DNA, 18 bp, Artificial
  synthetic oligonucleotide
gcggccacgccgccccgc

SEQ ID NO: 457 - DNA, 16 bp, Artificial
  synthetic oligonucleotide
gcggccacgccgcccc

SEQ ID NO: 458 - DNA, 15 bp, Artificial
  synthetic oligonucleotide
gcggccacgccgccc

SEQ ID NO: 459 - DNA, 28 bp, Artificial
  synthetic oligonucleotide
gcggccacgacgccccgctgaccggtct

SEQ ID NO: 460 - DNA, 28 bp, Artificial
  synthetic oligonucleotide
gcggccacgccgctccgctgaccggtct

SEQ ID NO: 461 - DNA, 28 bp, Artificial
  synthetic oligonucleotide
gcggccacgccgccccgcggaccggtct

SEQ ID NO: 462 - DNA, 1746 bp, Homo sapiens
ggatcccagcctttccccagcccgtagccccgggacctccgcggtgggcggcgccgcgctgccggcgcagggagggcctctggtgcaccggcaccgctgagtcgggttctctcgccggcctgttcccgggagagcccggggccctgctcggagatgccgccccgggcccccagacaccggctccctggccttcctcgagcaaccccgagctcggctccggtctccagccaagcccaaccccgagaggccgcggccctactggctccgcctcccgcgttgctcccggaagccccgcccgaccgcggctcctgacagacgggccgctcagccaaccggggtggggcggggcccgatggcgcgcagccaatggtaggccgcgcctggcagacggacgggcgcggggcggggcgtgcgcaggcccgcccgagtctccgccgcccgtgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtgagtgcgggcagggatcggccgggccgcgcgccctcctcgcccccaggcggcagcaatacgcgcggcgcgggccgggggcgcggggccggcgggcgtaagcggcggcggcggcggcggcggcgggtgggtggggccgggcggggcccgcgggcacaggtgagcgggcgtcgggggctgcggcgggcgggggccccttcctccctggggcctgcgggaatccgggccccacccgtggcctcgcgctgggcacggtccccacgccggcgtacccgggagcctcgggcccggcgccctcacacccgggggcgtctgggaggaggcggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtaggcacgctgcagtccttgctgcctggcgttggggcccagggaccgctgtgggtttgcccttcagatggccctgccagcagctgccctgtggggcctggggctgggcctgggcctggctgagcagggccctccttggcaggtggggcaggagaccctgtaggaggaccccgggccgcaggcccctgaggagcgatgacggaatataagctggtggtggtgggcgccggcggtgtgggcaagagtgcgctgaccatccagctgatccagaa

SEQ ID NO: 463 - DNA, 25 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgg

SEQ ID NO: 464 - DNA, 26 bp, Artificial
  synthetic oligonucleotide
ggcgcgcggttcgccccgcgcatggg

SEQ ID NO: 465 - DNA, 32 bp, Artificial
  synthetic oligonucleotide
  modified_base (4)..(4): c or methylated C nucleotide
  modified_base (10)..(10): c or methylated C nucleotide
  modified_base (27)..(27): c or methylated C nucleotide
ttccgtcatcgctcctcaggggcctgcggccc

SEQ ID NO: 466 - DNA, 28 bp, Artificial
  synthetic oligonucleotide
  modified_base (2)..(2): c or methylated C nucleotide
  modified_base (6)..(6): c or methylated C nucleotide
  modified_base (11)..(11): c or methylated C nucleotide
  modified_base (16)..(16): c or methylated C nucleotide
  modified_base (18)..(18): c or methylated C nucleotide
  modified_base (22)..(22): c or methylated C nucleotide
  modified_base (26)..(26): c or methylated C nucleotide
gcgcacgccccgccccgcgcccgtccgt

SEQ ID NO: 467 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggt

SEQ ID NO: 468 - DNA, 30 bp, Artificial
  synthetic oligonucleotide
  modified_base (7)..(7): c or methylated C nucleotide
  modified_base (11)..(11): c or methylated C nucleotide
  modified_base (27)..(27): c or methylated C nucleotide
gggaggcgcccgagggctgaggttaccgtc

SEQ ID NO: 469 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctcc

SEQ ID NO: 470 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcg

SEQ ID NO: 471 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccgg

SEQ ID NO: 472 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccgg

SEQ ID NO: 473 - DNA, 28 bp, Artificial
  synthetic oligonucleotide
  modified_base (2)..(2): c or methylated C nucleotide
  modified_base (5)..(5): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (20)..(20): c or methylated C nucleotide
  modified_base (26)..(26): c or methylated C nucleotide
acggcggagcgcgccacggcgtgcccgg

SEQ ID NO: 474 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgccccca

SEQ ID NO: 475 - DNA, 32 bp, Artificial
  synthetic oligonucleotide
  modified_base (2)..(2): c or methylated C nucleotide
  modified_base (8)..(8): c or methylated C nucleotide
  modified_base (25)..(25): c or methylated C nucleotide
  modified_base (30)..(30): c or methylated C nucleotide
ccgtcatcgctcctcaggggcctgcggcccgg

SEQ ID NO: 476 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgct

SEQ ID NO: 477 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccgg

SEQ ID NO: 478 - DNA, 55 bp, Artificial
  synthetic oligonucleotide
  modified_base (4)..(4): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (26)..(26): c or methylated C nucleotide
  modified_base (32)..(32): c or methylated C nucleotide
  modified_base (34)..(34): c or methylated C nucleotide
  modified_base (36)..(36): c or methylated C nucleotide
  modified_base (41)..(41): c or methylated C nucleotide
  modified_base (46)..(46): c or methylated C nucleotide
  modified_base (48)..(48): c or methylated C nucleotide
ggccgaggccggggcggggcgggggcgggggcgcgcggttcgccccgcgcatggg

SEQ ID NO: 479 - DNA, 33 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
  modified_base (20)..(20): c or methylated C nucleotide
  modified_base (24)..(24): c or methylated C nucleotide
  modified_base (26)..(26): c or methylated C nucleotide
  modified_base (29)..(29): c or methylated C nucleotide
tcgccccgcgcatgggctccgtccgcggcgggt

SEQ ID NO: 480 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggca

SEQ ID NO: 481 - DNA, 38 bp, Artificial
  synthetic oligonucleotide
gcgccggcagcgcggcgccgcccaccgcggaggtcccg

SEQ ID NO: 482 - DNA, 33 bp, Artificial
  synthetic oligonucleotide
cggcgagagaacccgactcagcggtgccggtgc

SEQ ID NO: 483 - DNA, 34 bp, Artificial
  synthetic oligonucleotide
gcggcatctccgagcagggccccgggctctcccg

SEQ ID NO: 484 - DNA, 25 bp, Artificial
  synthetic oligonucleotide
ccggagccgagctcggggttgctcg

SEQ ID NO: 485 - DNA, 28 bp, Artificial
  synthetic oligonucleotide
gcggagccagtagggccgcggcctctcg

SEQ ID NO: 486 - DNA, 22 bp, Artificial
  synthetic oligonucleotide
cggggcttccgggagcaacgcg

SEQ ID NO: 487 - DNA, 27 bp, Artificial
  synthetic oligonucleotide
cggcccgtctgtcaggagccgcggtcg

SEQ ID NO: 488 - DNA, 24 bp, Artificial
  synthetic oligonucleotide
cgggcggcggagactcgggcgggc

SEQ ID NO: 489 - DNA, 37 bp, Artificial
  synthetic oligonucleotide
ccgttcacaggcgcgactgcccccgggccagggccgg

SEQ ID NO: 490 - DNA, 24 bp, Artificial
  synthetic oligonucleotide
cgaggagggcgcgcggcccggccg

SEQ ID NO: 491 - DNA, 34 bp, Artificial
  synthetic oligonucleotide
cgcgaggccacgggtggggcccggattcccgcag

SEQ ID NO: 492 - DNA, 26 bp, Artificial
  synthetic oligonucleotide
cgggtacgccggcgtggggaccgtgc

SEQ ID NO: 493 - DNA, 31 bp, Artificial
  synthetic oligonucleotide
cgcccccgggtgtgagggcgccgggcccgag

SEQ ID NO: 494 - DNA, 25 bp, Artificial
  synthetic oligonucleotide
cgggcgtgccgtggccgcggccgcc

SEQ ID NO: 495 - DNA, 30 bp, Artificial
  synthetic oligonucleotide
cgagaagcggcgcgggagacccggagaggg

SEQ ID NO: 496 - DNA, 28 bp, Artificial
  synthetic oligonucleotide
gcgccccgcacccccggcggggaaccgg

SEQ ID NO: 497 - DNA, 35 bp, Artificial
  synthetic oligonucleotide
gcgtactaggcgccgccgaggggagggcagacccg

SEQ ID NO: 498 - DNA, 38 bp, Artificial
  synthetic oligonucleotide
cgcggcgctggtgcctccgacaagtatttgctgagcgc

SEQ ID NO: 499 - DNA, 25 bp, Artificial
  synthetic oligonucleotide
gggagccggtgtctgggggcccggg

SEQ ID NO: 500 - DNA, 25 bp, Artificial
  synthetic oligonucleotide
ctgccaggcgcggcctaccattggc

SEQ ID NO: 501 - DNA, 24 bp, Artificial
  synthetic oligonucleotide
ctgtgcccgcgggccccgcccggc

SEQ ID NO: 502 - DNA, 39 bp, Artificial
  synthetic oligonucleotide
cggcctggtccgcgacctgtgatgctgaatcgggggtgc

SEQ ID NO: 503 - DNA, 29 bp, Artificial
  synthetic oligonucleotide
cagcgcactcttgccacaccgccggcgcc

SEQ ID NO: 504 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatggg

SEQ ID NO: 505 - DNA, 27 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgcatggg

SEQ ID NO: 506 - DNA, 28 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgcatggg

SEQ ID NO: 507 - DNA, 29 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcatggg

SEQ ID NO: 508 - DNA, 30 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatggg

SEQ ID NO: 509 - DNA, 31 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcgcatggg

SEQ ID NO: 510 - DNA, 27 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggc

SEQ ID NO: 511 - DNA, 28 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggct

SEQ ID NO: 512 - DNA, 29 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggctc

SEQ ID NO: 513 - DNA, 30 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggctcc

SEQ ID NO: 514 - DNA, 31 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggctccg

SEQ ID NO: 515 - DNA, 28 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgcatgggc

SEQ ID NO: 516 - DNA, 30 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgcatgggct

SEQ ID NO: 517 - DNA, 32 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcatgggctc

SEQ ID NO: 518 - DNA, 34 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatgggctcc

SEQ ID NO: 519 - DNA, 36 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcgcatgggctccg

SEQ ID NO: 520 - DNA, 26 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcat

SEQ ID NO: 521 - DNA, 26 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
ggcgggggcgcgcggttcgccccgcg

SEQ ID NO: 522 - DNA, 26 bp, Artificial
  synthetic oligonucleotide
  modified_base (12)..(12): c or methylated C nucleotide
  modified_base (14)..(14): c or methylated C nucleotide
  modified_base (16)..(16): c or methylated C nucleotide
  modified_base (21)..(21): c or methylated C nucleotide
  modified_base (26)..(26): c or methylated C nucleotide
gggggcgggggcgcgcggttcgcccc

SEQ ID NO: 523 - DNA, 26 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
  modified_base (24)..(24): c or methylated C nucleotide
ggcgggggcgggggcgcgcggttcgc

SEQ ID NO: 524 - DNA, 26 bp, Artificial
  synthetic oligonucleotide
  modified_base (18)..(18): c or methylated C nucleotide
  modified_base (20)..(20): c or methylated C nucleotide
  modified_base (22)..(22): c or methylated C nucleotide
cggggcgggggcgggggcgcgcggtt

SEQ ID NO: 525 - DNA, 26 bp, Artificial
  synthetic oligonucleotide
  modified_base (2)..(2): c or methylated C nucleotide
  modified_base (4)..(4): c or methylated C nucleotide
  modified_base (9)..(9): c or methylated C nucleotide
  modified_base (14)..(14): c or methylated C nucleotide
  modified_base (16)..(16): c or methylated C nucleotide
gcgcggttcgccccgcgcatgggctc

SEQ ID NO: 526 - DNA, 26 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatgggctccgt

SEQ ID NO: 527 - DNA, 26 bp, Artificial
  synthetic oligonucleotide
  modified_base (3)..(3): c or methylated C nucleotide
  modified_base (8)..(8): c or methylated C nucleotide
  modified_base (10)..(10): c or methylated C nucleotide
ttcgccccgcgcatgggctccgtccg

SEQ ID NO: 528 - DNA, 26 bp, Artificial
  synthetic oligonucleotide
  modified_base (5)..(5): c or methylated C nucleotide
  modified_base (7)..(7): c or methylated C nucleotide
gccccgcgcatgggctccgtccgcgg

SEQ ID NO: 529 - DNA, 26 bp, Artificial
  synthetic oligonucleotide
  modified_base (2)..(2): c or methylated C nucleotide
  modified_base (4)..(4): c or methylated C nucleotide
ccgcgcatgggctccgtccgcgggcc

SEQ ID NO: 530 - DNA, 24 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcgcatggg

SEQ ID NO: 531 - DNA, 22 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
cgcggttcgccccgcgcatggg

SEQ ID NO: 532 - DNA, 20 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatggg

SEQ ID NO: 533 - DNA, 18 bp, Artificial
  synthetic oligonucleotide
  modified_base (4)..(4): c or methylated C nucleotide
  modified_base (9)..(9): c or methylated C nucleotide
  modified_base (11)..(11): c or methylated C nucleotide
gttcgccccgcgcatggg

SEQ ID NO: 534 - DNA, 16 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
tcgccccgcgcatggg

SEQ ID NO: 535 - DNA, 15 bp, Artificial
  synthetic oligonucleotide
  modified_base (1)..(1): c or methylated C nucleotide
  modified_base (6)..(6): c or methylated C nucleotide
  modified_base (8)..(8): c or methylated C nucleotide
cgccccgcgcatggg

SEQ ID NO: 536 - DNA, 24 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatg

SEQ ID NO: 537 - DNA, 22 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgca

SEQ ID NO: 538 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcg

SEQ ID NO: 539 - DNA, 18 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
ggcgcgcggttcgccccg

SEQ ID NO: 540 - DNA, 16 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgccc

SEQ ID NO: 541 - DNA, 15 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgcc

SEQ ID NO: 542 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcccggttcgccccgcgcatggg

SEQ ID NO: 543 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgctccgcgcatggg

SEQ ID NO: 544 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcagttcgccccgcgcatggg

SEQ ID NO: 545 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggt

SEQ ID NO: 546 - DNA, 28 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (21)..(21): c or methylated C nucleotide
  modified_base (23)..(23): c or methylated C nucleotide
  modified_base (25)..(25): c or methylated C nucleotide
aggcggggcgggggcgggggcgcgcggt

SEQ ID NO: 547 - DNA, 29 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (22)..(22): c or methylated C nucleotide
  modified_base (24)..(24): c or methylated C nucleotide
  modified_base (26)..(26): c or methylated C nucleotide
gaggcggggcgggggcgggggcgcgcggt

SEQ ID NO: 548 - DNA, 30 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (23)..(23): c or methylated C nucleotide
  modified_base (25)..(25): c or methylated C nucleotide
  modified_base (27)..(27): c or methylated C nucleotide
cgaggcggggcgggggcgggggcgcgcggt

SEQ ID NO: 549 - DNA, 31 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (24)..(24): c or methylated C nucleotide
  modified_base (26)..(26): c or methylated C nucleotide
  modified_base (28)..(28): c or methylated C nucleotide
ccgaggcggggcgggggcgggggcgcgcggt

SEQ ID NO: 550 - DNA, 32 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (25)..(25): c or methylated C nucleotide
  modified_base (27)..(27): c or methylated C nucleotide
  modified_base (29)..(29): c or methylated C nucleotide
gccgaggcggggcgggggcgggggcgcgcggt

SEQ ID NO: 551 - DNA, 28 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggtt

SEQ ID NO: 552 - DNA, 29 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttc

SEQ ID NO: 553 - DNA, 30 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttcg

SEQ ID NO: 554 - DNA, 31 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttcgc

SEQ ID NO: 555 - DNA, 32 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttcgcc

SEQ ID NO: 556 - DNA, 29 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (21)..(21): c or methylated C nucleotide
  modified_base (23)..(23): c or methylated C nucleotide
  modified_base (25)..(25): c or methylated C nucleotide
aggcggggcgggggcgggggcgcgcggtt

SEQ ID NO: 557 - DNA, 31 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (22)..(22): c or methylated C nucleotide
  modified_base (24)..(24): c or methylated C nucleotide
  modified_base (26)..(26): c or methylated C nucleotide
gaggcggggcgggggcgggggcgcgcggttc

SEQ ID NO: 558 - DNA, 33 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (23)..(23): c or methylated C nucleotide
  modified_base (25)..(25): c or methylated C nucleotide
  modified_base (27)..(27): c or methylated C nucleotide
cgaggcggggcgggggcgggggcgcgcggttcg

SEQ ID NO: 559 - DNA, 35 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (24)..(24): c or methylated C nucleotide
  modified_base (26)..(26): c or methylated C nucleotide
  modified_base (28)..(28): c or methylated C nucleotide
ccgaggcggggcgggggcgggggcgcgcggttcgc

SEQ ID NO: 560 - DNA, 37 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (25)..(25): c or methylated C nucleotide
  modified_base (27)..(27): c or methylated C nucleotide
  modified_base (29)..(29): c or methylated C nucleotide
gccgaggcggggcgggggcgggggcgcgcggttcgcc

SEQ ID NO: 561 - DNA, 27 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (23)..(23): c or methylated C nucleotide
  modified_base (25)..(25): c or methylated C nucleotide
  modified_base (27)..(27): c or methylated C nucleotide
cgaggcggggcgggggcgggggcgcgc

SEQ ID NO: 562 - DNA, 27 bp, Artificial
  synthetic oligonucleotide
  modified_base (9)..(9): c or methylated C nucleotide
  modified_base (14)..(14): c or methylated C nucleotide
  modified_base (20)..(20): c or methylated C nucleotide
  modified_base (26)..(26): c or methylated C nucleotide
ggccgaggcggggcgggggcgggggcg

SEQ ID NO: 563 - DNA, 27 bp, Artificial
  synthetic oligonucleotide
  modified_base (12)..(12): c or methylated C nucleotide
  modified_base (17)..(17): c or methylated C nucleotide
  modified_base (23)..(23): c or methylated C nucleotide
cggggccgaggcggggcgggggcgggg

SEQ ID NO: 564 - DNA, 27 bp, Artificial
  synthetic oligonucleotide
  modified_base (15)..(15): c or methylated C nucleotide
  modified_base (20)..(20): c or methylated C nucleotide
  modified_base (26)..(26): c or methylated C nucleotide
ggccggggccgaggcggggcgggggcg

SEQ ID NO: 565 - DNA, 27 bp, Artificial
  synthetic oligonucleotide
  modified_base (18)..(18): c or methylated C nucleotide
  modified_base (23)..(23): c or methylated C nucleotide
cagggccggggccgaggcggggcgggg

SEQ ID NO: 566 - DNA, 27 bp, Artificial
  synthetic oligonucleotide
  modified_base (5)..(5): c or methylated C nucleotide
  modified_base (11)..(11): c or methylated C nucleotide
  modified_base (17)..(17): c or methylated C nucleotide
  modified_base (19)..(19): c or methylated C nucleotide
  modified_base (21)..(21): c or methylated C nucleotide
ggggcgggggcgggggcgcgcggttcg

SEQ ID NO: 567 - DNA, 27 bp, Artificial
  synthetic oligonucleotide
  modified_base (2)..(2): c or methylated C nucleotide
  modified_base (8)..(8): c or methylated C nucleotide
  modified_base (14)..(14): c or methylated C nucleotide
  modified_base (16)..(16): c or methylated C nucleotide
  modified_base (18)..(18): c or methylated C nucleotide
gcgggggcgggggcgcgcggttcgccc

SEQ ID NO: 568 - DNA, 27 bp, Artificial
  synthetic oligonucleotide
  modified_base (5)..(5): c or methylated C nucleotide
  modified_base (11)..(11): c or methylated C nucleotide
  modified_base (13)..(13): c or methylated C nucleotide
  modified_base (15)..(15): c or methylated C nucleotide
ggggcgggggcgcgcggttcgccccgc

SEQ ID NO: 569 - DNA, 27 bp, Artificial
  synthetic oligonucleotide
  modified_base (2)..(2): c or methylated C nucleotide
  modified_base (8)..(8): c or methylated C nucleotide
  modified_base (10)..(10): c or methylated C nucleotide
  modified_base (12)..(12): c or methylated C nucleotide
gcgggggcgcgcggttcgccccgcgca

SEQ ID NO: 570 - DNA, 27 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
ggggcgcgcggttcgccccgcgcatgg

SEQ ID NO: 571 - DNA, 25 bp, Artificial
  synthetic oligonucleotide
  modified_base (1)..(1): c or methylated C nucleotide
  modified_base (6)..(6): c or methylated C nucleotide
  modified_base (12)..(12): c or methylated C nucleotide
  modified_base (18)..(18): c or methylated C nucleotide
  modified_base (20)..(20): c or methylated C nucleotide
  modified_base (22)..(22): c or methylated C nucleotide
cggggcgggggcgggggcgcgcggt

SEQ ID NO: 572 - DNA, 23 bp, Artificial
  synthetic oligonucleotide
  modified_base (4)..(4): c or methylated C nucleotide
  modified_base (10)..(10): c or methylated C nucleotide
  modified_base (16)..(16): c or methylated C nucleotide
  modified_base (18)..(18): c or methylated C nucleotide
  modified_base (20)..(20): c or methylated C nucleotide
gggcgggggcgggggcgcgcggt

SEQ ID NO: 573 - DNA, 21 bp, Artificial
  synthetic oligonucleotide
  modified_base (2)..(2): c or methylated C nucleotide
  modified_base (8)..(8): c or methylated C nucleotide
  modified_base (14)..(14): c or methylated C nucleotide
  modified_base (16)..(16): c or methylated C nucleotide
  modified_base (18)..(18): c or methylated C nucleotide
gcgggggcgggggcgcgcggt

SEQ ID NO: 574 - DNA, 19 bp, Artificial
  synthetic oligonucleotide
  modified_base (6)..(6): c or methylated C nucleotide
  modified_base (12)..(12): c or methylated C nucleotide
  modified_base (14)..(14): c or methylated C nucleotide
  modified_base (16)..(16): c or methylated C nucleotide
gggggcgggggcgcgcggt

SEQ ID NO: 575 - DNA, 17 bp, Artificial
  synthetic oligonucleotide
  modified_base (4)..(4): c or methylated C nucleotide
  modified_base (10)..(10): c or methylated C nucleotide
  modified_base (12)..(12): c or methylated C nucleotide
  modified_base (14)..(14): c or methylated C nucleotide
gggcgggggcgcgcggt

SEQ ID NO: 576 - DNA, 15 bp, Artificial
  synthetic oligonucleotide
  modified_base (2)..(2): c or methylated C nucleotide
  modified_base (8)..(8): c or methylated C nucleotide
  modified_base (10)..(10): c or methylated C nucleotide
  modified_base (12)..(12): c or methylated C nucleotide
gcgggggcgcgcggt

SEQ ID NO: 577 - DNA, 25 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcg

SEQ ID NO: 578 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
ggcggggcgggggcgggggcgcg

SEQ ID NO: 579 - DNA, 21 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
ggcggggcgggggcgggggcg

SEQ ID NO: 580 - DNA, 19 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
ggcggggcgggggcggggg

SEQ ID NO: 581 - DNA, 17 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
ggcggggcgggggcggg

SEQ ID NO: 582 - DNA, 15 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
ggcggggcgggggcg

SEQ ID NO: 583 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcgaggcgggggcgggggcgcgcggt

SEQ ID NO: 584 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggtgcgcgcggt

SEQ ID NO: 585 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgcgggcgggggcgcgcggt

SEQ ID NO: 586 - DNA, 32 bp, Artificial; identical to SEQ ID NO: 472
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide

SEQ ID NO: 587 - DNA, 33 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (24)..(24): c or methylated C nucleotide
  modified_base (28)..(28): c or methylated C nucleotide
  modified_base (31)..(31): c or methylated C nucleotide
cccgccgccgccgccgccgcttacgcccgccgg

SEQ ID NO: 588 - DNA, 34 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (25)..(25): c or methylated C nucleotide
  modified_base (29)..(29): c or methylated C nucleotide
  modified_base (32)..(32): c or methylated C nucleotide
acccgccgccgccgccgccgcttacgcccgccgg

SEQ ID NO: 589 - DNA, 35 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (26)..(26): c or methylated C nucleotide
  modified_base (30)..(30): c or methylated C nucleotide
  modified_base (33)..(33): c or methylated C nucleotide
cacccgccgccgccgccgccgcttacgcccgccgg

SEQ ID NO: 590 - DNA, 36 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (21)..(21): c or methylated C nucleotide
  modified_base (27)..(27): c or methylated C nucleotide
  modified_base (31)..(31): c or methylated C nucleotide
  modified_base (34)..(34): c or methylated C nucleotide
ccacccgccgccgccgccgccgcttacgcccgccgg

SEQ ID NO: 591 - DNA, 37 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (22)..(22): c or methylated C nucleotide
  modified_base (28)..(28): c or methylated C nucleotide
  modified_base (32)..(32): c or methylated C nucleotide
  modified_base (35)..(35): c or methylated C nucleotide
cccacccgccgccgccgccgccgcttacgcccgccgg

SEQ ID NO: 592 - DNA, 33 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggc

SEQ ID NO: 593 - DNA, 34 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggcc

SEQ ID NO: 594 - DNA, 35 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggccc

SEQ ID NO: 595 - DNA, 36 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggcccc

SEQ ID NO: 596 - DNA, 37 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggccccg

SEQ ID NO: 597 - DNA, 34 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (24)..(24): c or methylated C nucleotide
  modified_base (28)..(28): c or methylated C nucleotide
  modified_base (31)..(31): c or methylated C nucleotide
cccgccgccgccgccgccgcttacgcccgccggc

SEQ ID NO: 598 - DNA, 36 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (25)..(25): c or methylated C nucleotide
  modified_base (29)..(29): c or methylated C nucleotide
  modified_base (32)..(32): c or methylated C nucleotide
acccgccgccgccgccgccgcttacgcccgccggcc

SEQ ID NO: 599 - DNA, 38 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (26)..(26): c or methylated C nucleotide
  modified_base (30)..(30): c or methylated C nucleotide
  modified_base (33)..(33): c or methylated C nucleotide
cacccgccgccgccgccgccgcttacgcccgccggccc

SEQ ID NO: 600 - DNA, 40 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (21)..(21): c or methylated C nucleotide
  modified_base (27)..(27): c or methylated C nucleotide
  modified_base (31)..(31): c or methylated C nucleotide
  modified_base (34)..(34): c or methylated C nucleotide
ccacccgccgccgccgccgccgcttacgcccgccggcccc

SEQ ID NO: 601 - DNA, 42 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (22)..(22): c or methylated C nucleotide
  modified_base (28)..(28): c or methylated C nucleotide
  modified_base (32)..(32): c or methylated C nucleotide
  modified_base (35)..(35): c or methylated C nucleotide
cccacccgccgccgccgccgccgcttacgcccgccggccccg

SEQ ID NO: 602 - DNA, 32 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (26)..(26): c or methylated C nucleotide
  modified_base (30)..(30): c or methylated C nucleotide
cacccgccgccgccgccgccgcttacgcccgc

SEQ ID NO: 603 - DNA, 32 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (23)..(23): c or methylated C nucleotide
  modified_base (29)..(29): c or methylated C nucleotide
acccacccgccgccgccgccgccgcttacgcc

SEQ ID NO: 604 - DNA, 32 bp, Artificial
  synthetic oligonucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (23)..(23): c or methylated C nucleotide
  modified_base (26)..(26): c or methylated C nucleotide
  modified_base (32)..(32): c or methylated C nucleotide
cccacccacccgccgccgccgccgccgcttac

SEQ ID NO: 605 - DNA, 32 bp, Artificial
  synthetic oligonucleotide
  modified_base (14)..(14): c or methylated C nucleotide
  modified_base (17)..(17): c or methylated C nucleotide
  modified_base (20)..(20): c or methylated C nucleotide
  modified_base (23)..(23): c or methylated C nucleotide
  modified_base (26)..(26): c or methylated C nucleotide
  modified_base (29)..(29): c or methylated C nucleotide
ggccccacccacccgccgccgccgccgccgct

SEQ ID NO: 606 - DNA, 32 bp, Artificial
  synthetic oligonucleotide
  modified_base (17)..(17): c or methylated C nucleotide
  modified_base (20)..(20): c or methylated C nucleotide
  modified_base (23)..(23): c or methylated C nucleotide
  modified_base (26)..(26): c or methylated C nucleotide
  modified_base (29)..(29): c or methylated C nucleotide
  modified_base (32)..(32): c or methylated C nucleotide
cccggccccacccacccgccgccgccgccgcc

SEQ ID NO: 607 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (20)..(20): c or methylated C nucleotide
  modified_base (24)..(24): c or methylated C nucleotide
  modified_base (27)..(27): c or methylated C nucleotide
ccgccgccgccgccgcttacgcccgccggccc

SEQ ID NO: 608 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (17)..(17): c or methylated C nucleotide
  modified_base (21)..(21): c or methylated C nucleotide
  modified_base (24)..(24): c or methylated C nucleotide
ccgccgccgccgcttacgcccgccggccccgc

SEQ ID NO: 609 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (14)..(14): c or methylated C nucleotide
  modified_base (18)..(18): c or methylated C nucleotide
  modified_base (21)..(21): c or methylated C nucleotide
ccgccgccgcttacgcccgccggccccgcgcc

SEQ ID NO: 610 - DNA, 32 bp, Artificial
  synthetic oligonucleotide
  modified_base (2)..(2): c or methylated C nucleotide
  modified_base (5)..(5): c or methylated C nucleotide
  modified_base (11)..(11): c or methylated C nucleotide
  modified_base (15)..(15): c or methylated C nucleotide
  modified_base (18)..(18): c or methylated C nucleotide
ccgccgcttacgcccgccggccccgcgccccc

SEQ ID NO: 611 - DNA, 32 bp, Artificial
  synthetic oligonucleotide
  modified_base (2)..(2): c or methylated C nucleotide
  modified_base (8)..(8): c or methylated C nucleotide
  modified_base (12)..(12): c or methylated C nucleotide
  modified_base (15)..(15): c or methylated C nucleotide
ccgcttacgcccgccggccccgcgcccccggc

SEQ ID NO: 612 - DNA, 30 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (21)..(21): c or methylated C nucleotide
  modified_base (25)..(25): c or methylated C nucleotide
  modified_base (28)..(28): c or methylated C nucleotide
gccgccgccgccgccgcttacgcccgccgg

SEQ ID NO: 613 - DNA, 28 bp, Artificial
  synthetic oligonucleotide
  modified_base (1)..(1): c or methylated C nucleotide
  modified_base (4)..(4): c or methylated C nucleotide
  modified_base (7)..(7): c or methylated C nucleotide
  modified_base (10)..(10): c or methylated C nucleotide
  modified_base (13)..(13): c or methylated C nucleotide
  modified_base (19)..(19): c or methylated C nucleotide
  modified_base (23)..(23): c or methylated C nucleotide
  modified_base (26)..(26): c or methylated C nucleotide
cgccgccgccgccgcttacgcccgccgg

SEQ ID NO: 614 - DNA, 26 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (17)..(17): c or methylated C nucleotide
  modified_base (21)..(21): c or methylated C nucleotide
  modified_base (24)..(24): c or methylated C nucleotide
ccgccgccgccgcttacgcccgccgg

SEQ ID NO: 615 - DNA, 24 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (15)..(15): c or methylated C nucleotide
  modified_base (19)..(19): c or methylated C nucleotide
  modified_base (22)..(22): c or methylated C nucleotide
gccgccgccgcttacgcccgccgg

SEQ ID NO: 616 - DNA, 22 bp, Artificial
  synthetic oligonucleotide
  modified_base (1)..(1): c or methylated C nucleotide
  modified_base (4)..(4): c or methylated C nucleotide
  modified_base (7)..(7): c or methylated C nucleotide
  modified_base (13)..(13): c or methylated C nucleotide
  modified_base (17)..(17): c or methylated C nucleotide
  modified_base (20)..(20): c or methylated C nucleotide
cgccgccgcttacgcccgccgg

SEQ ID NO: 617 - DNA, 20 bp, Artificial
  synthetic oligonucleotide
  modified_base (2)..(2): c or methylated C nucleotide
  modified_base (5)..(5): c or methylated C nucleotide
  modified_base (11)..(11): c or methylated C nucleotide
  modified_base (15)..(15): c or methylated C nucleotide
  modified_base (18)..(18): c or methylated C nucleotide
ccgccgcttacgcccgccgg

SEQ ID NO: 618 - DNA, 18 bp, Artificial
  synthetic oligonucleotide
  modified_base (3)..(3): c or methylated C nucleotide
  modified_base (9)..(9): c or methylated C nucleotide
  modified_base (13)..(13): c or methylated C nucleotide
  modified_base (16)..(16): c or methylated C nucleotide
gccgcttacgcccgccgg

SEQ ID NO: 619 - DNA, 16 bp, Artificial
  synthetic oligonucleotide
  modified_base (1)..(1): c or methylated C nucleotide
  modified_base (7)..(7): c or methylated C nucleotide
  modified_base (11)..(11): c or methylated C nucleotide
  modified_base (14)..(14): c or methylated C nucleotide
cgcttacgcccgccgg

SEQ ID NO: 620 - DNA, 15 bp, Artificial
  synthetic oligonucleotide
  modified_base (6)..(6): c or methylated C nucleotide
  modified_base (10)..(10): c or methylated C nucleotide
  modified_base (13)..(13): c or methylated C nucleotide
gcttacgcccgccgg

SEQ ID NO: 621 - DNA, 30 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgcc

SEQ ID NO: 622 - DNA, 28 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
ccgccgccgccgccgccgcttacgcccg

SEQ ID NO: 623 - DNA, 26 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
ccgccgccgccgccgccgcttacgcc

SEQ ID NO: 624 - DNA, 24 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
ccgccgccgccgccgccgcttacg

SEQ ID NO: 625 - DNA, 22 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
ccgccgccgccgccgccgctta

SEQ ID NO: 626 - DNA, 20 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
ccgccgccgccgccgccgct

SEQ ID NO: 627 - DNA, 18 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
ccgccgccgccgccgccg

SEQ ID NO: 628 - DNA, 16 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
ccgccgccgccgccgc

SEQ ID NO: 629 - DNA, 15 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
ccgccgccgccgccg

SEQ ID NO: 630 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccaccgccgccgcttacgcccgccgg

SEQ ID NO: 631 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttccgcccgccgg

SEQ ID NO: 632 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccaccgcttacgcccgccgg

SEQ ID NO: 633 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgct

SEQ ID NO: 634 - DNA, 29 bp, Artificial
  synthetic oligonucleotide
  modified_base (3)..(3): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (26)..(26): c or methylated C nucleotide
cccgcccgccgcagcccccgacgcccgct

SEQ ID NO: 635 - DNA, 30 bp, Artificial
  synthetic oligonucleotide
  modified_base (4)..(4): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (27)..(27): c or methylated C nucleotide
ccccgcccgccgcagcccccgacgcccgct

SEQ ID NO: 636 - DNA, 31 bp, Artificial
  synthetic oligonucleotide
  modified_base (5)..(5): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (28)..(28): c or methylated C nucleotide
cccccgcccgccgcagcccccgacgcccgct

SEQ ID NO: 637 - DNA, 32 bp, Artificial
  synthetic oligonucleotide
  modified_base (6)..(6): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (29)..(29): c or methylated C nucleotide
gcccccgcccgccgcagcccccgacgcccgct

SEQ ID NO: 638 - DNA, 33 bp, Artificial
  synthetic oligonucleotide
  modified_base (7)..(7): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (30)..(30): c or methylated C nucleotide
ggcccccgcccgccgcagcccccgacgcccgct

SEQ ID NO: 639 - DNA, 29 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctc

SEQ ID NO: 640 - DNA, 30 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctca

SEQ ID NO: 641 - DNA, 31 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctcac

SEQ ID NO: 642 - DNA, 32 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctcacc

SEQ ID NO: 643 - DNA, 33 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctcacct

SEQ ID NO: 644 - DNA, 30 bp, Artificial
  synthetic oligonucleotide
  modified_base (3)..(3): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (26)..(26): c or methylated C nucleotide
cccgcccgccgcagcccccgacgcccgctc

SEQ ID NO: 645 - DNA, 32 bp, Artificial
  synthetic oligonucleotide
  modified_base (4)..(4): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (27)..(27): c or methylated C nucleotide
ccccgcccgccgcagcccccgacgcccgctca

SEQ ID NO: 646 - DNA, 34 bp, Artificial
  synthetic oligonucleotide
  modified_base (5)..(5): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (28)..(28): c or methylated C nucleotide
cccccgcccgccgcagcccccgacgcccgctcac

SEQ ID NO: 647 - DNA, 36 bp, Artificial
  synthetic oligonucleotide
  modified_base (6)..(6): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (29)..(29): c or methylated C nucleotide
gcccccgcccgccgcagcccccgacgcccgctcacc

SEQ ID NO: 648 - DNA, 38 bp, Artificial
  synthetic oligonucleotide
  modified_base (7)..(7): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (30)..(30): c or methylated C nucleotide
ggcccccgcccgccgcagcccccgacgcccgctcacct

SEQ ID NO: 649 - DNA, 28 bp, Artificial
  synthetic oligonucleotide
  modified_base (5)..(5): c or methylated C nucleotide
  modified_base (9)..(9): c or methylated C nucleotide
  modified_base (12)..(12): c or methylated C nucleotide
  modified_base (24)..(24): c or methylated C nucleotide
  modified_base (28)..(28): c or methylated C nucleotide
cccccgcccgccgcagcccccgacgccc

SEQ ID NO: 650 - DNA, 28 bp, Artificial
  synthetic oligonucleotide
  modified_base (8)..(8): c or methylated C nucleotide
  modified_base (12)..(12): c or methylated C nucleotide
  modified_base (15)..(15): c or methylated C nucleotide
  modified_base (24)..(24): c or methylated C nucleotide
  modified_base (27)..(27): c or methylated C nucleotide
gggcccccgcccgccgcagcccccgacg

SEQ ID NO: 651 - DNA, 28 bp, Artificial
  synthetic oligonucleotide
  modified_base (11)..(11): c or methylated C nucleotide
  modified_base (15)..(15): c or methylated C nucleotide
  modified_base (18)..(18): c or methylated C nucleotide
  modified_base (27)..(27): c or methylated C nucleotide
aaggggcccccgcccgccgcagcccccg

SEQ ID NO: 652 - DNA, 28 bp, Artificial
  synthetic oligonucleotide
  modified_base (14)..(14): c or methylated C nucleotide
  modified_base (18)..(18): c or methylated C nucleotide
  modified_base (21)..(21): c or methylated C nucleotide
aggaaggggcccccgcccgccgcagccc

SEQ ID NO: 653 - DNA, 28 bp, Artificial
  synthetic oligonucleotide
  modified_base (17)..(17): c or methylated C nucleotide
  modified_base (21)..(21): c or methylated C nucleotide
  modified_base (24)..(24): c or methylated C nucleotide
gggaggaaggggcccccgcccgccgcag

SEQ ID NO: 654 - DNA, 28 bp, Artificial
  synthetic oligonucleotide
  modified_base (3)..(3): c or methylated C nucleotide
  modified_base (6)..(6): c or methylated C nucleotide
  modified_base (15)..(15): c or methylated C nucleotide
  modified_base (18)..(18): c or methylated C nucleotide
  modified_base (22)..(22): c or methylated C nucleotide
cccgccgcagcccccgacgcccgctcac

SEQ ID NO: 655 - DNA, 28 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (19)..(19): c or methylated C nucleotide
gccgcagcccccgacgcccgctcacctg

SEQ ID NO: 656 - DNA, 28 bp, Artificial
  synthetic oligonucleotide
  modified_base (9)..(9): c or methylated C nucleotide
  modified_base (12)..(12): c or methylated C nucleotide
  modified_base (16)..(16): c or methylated C nucleotide
gcagcccccgacgcccgctcacctgtgc

SEQ ID NO: 657 - DNA, 28 bp, Artificial
  synthetic oligonucleotide
  modified_base (6)..(6): c or methylated C nucleotide
  modified_base (9)..(9): c or methylated C nucleotide
  modified_base (13)..(13): c or methylated C nucleotide
gcccccgacgcccgctcacctgtgcccg

SEQ ID NO: 658 - DNA, 28 bp, Artificial
  synthetic oligonucleotide
  modified_base (3)..(3): c or methylated C nucleotide
  modified_base (6)..(6): c or methylated C nucleotide
  modified_base (10)..(10): c or methylated C nucleotide
cccgacgcccgctcacctgtgcccgcgg

SEQ ID NO: 659 - DNA, 26 bp, Artificial
  synthetic oligonucleotide
  modified_base (4)..(4): c or methylated C nucleotide
  modified_base (7)..(7): c or methylated C nucleotide
  modified_base (16)..(16): c or methylated C nucleotide
  modified_base (19)..(19): c or methylated C nucleotide
  modified_base (23)..(23): c or methylated C nucleotide
gcccgccgcagcccccgacgcccgct

SEQ ID NO: 660 - DNA, 24 bp, Artificial
  synthetic oligonucleotide
  modified_base (2)..(2): c or methylated C nucleotide
  modified_base (5)..(5): c or methylated C nucleotide
  modified_base (14)..(14): c or methylated C nucleotide
  modified_base (17)..(17): c or methylated C nucleotide
  modified_base (21)..(21): c or methylated C nucleotide
ccgccgcagcccccgacgcccgct

SEQ ID NO: 661 - DNA, 22 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (19)..(19): c or methylated C nucleotide
gccgcagcccccgacgcccgct

SEQ ID NO: 662 - DNA, 20 bp, Artificial
  synthetic oligonucleotide
  modified_base (1)..(1): c or methylated C nucleotide
  modified_base (10)..(10): c or methylated C nucleotide
  modified_base (13)..(13): c or methylated C nucleotide
  modified_base (17)..(17): c or methylated C nucleotide
cgcagcccccgacgcccgct

SEQ ID NO: 663 - DNA, 18 bp, Artificial
  synthetic oligonucleotide
  modified_base (8)..(8): c or methylated C nucleotide
  modified_base (11)..(11): c or methylated C nucleotide
  modified_base (15)..(15): c or methylated C nucleotide
cagcccccgacgcccgct

SEQ ID NO: 664 - DNA, 16 bp, Artificial
  synthetic oligonucleotide
  modified_base (6)..(6): c or methylated C nucleotide
  modified_base (9)..(9): c or methylated C nucleotide
  modified_base (13)..(13): c or methylated C nucleotide
gcccccgacgcccgct

SEQ ID NO: 665 - DNA, 15 bp, Artificial
  synthetic oligonucleotide
  modified_base (5)..(5): c or methylated C nucleotide
  modified_base (8)..(8): c or methylated C nucleotide
  modified_base (12)..(12): c or methylated C nucleotide
cccccgacgcccgct

SEQ ID NO: 666 - DNA, 26 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccg

SEQ ID NO: 667 - DNA, 24 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ccgcccgccgcagcccccgacgcc

SEQ ID NO: 668 - DNA, 22 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ccgcccgccgcagcccccgacg

SEQ ID NO: 669 - DNA, 20 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
ccgcccgccgcagcccccga

SEQ ID NO: 670 - DNA, 18 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
ccgcccgccgcagccccc

SEQ ID NO: 671 - DNA, 16 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
ccgcccgccgcagccc

SEQ ID NO: 672 - DNA, 15 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
ccgcccgccgcagcc

SEQ ID NO: 673 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcacgccgcagcccccgacgcccgct

SEQ ID NO: 674 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagccctcgacgcccgct

SEQ ID NO: 675 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcgcccgacgcccgct

SEQ ID NO: 676 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccgg

SEQ ID NO: 677 - DNA, 30 bp, Artificial
  synthetic oligonucleotide
  modified_base (3)..(3): c or methylated C nucleotide
  modified_base (5)..(5): c or methylated C nucleotide
  modified_base (11)..(11): c or methylated C nucleotide
  modified_base (18)..(18): c or methylated C nucleotide
  modified_base (28)..(28): c or methylated C nucleotide
tgcgcgccatcgggccccgccccaccccgg

SEQ ID NO: 678 - DNA, 31 bp, Artificial
  synthetic oligonucleotide
  modified_base (4)..(4): c or methylated C nucleotide
  modified_base (6)..(6): c or methylated C nucleotide
  modified_base (12)..(12): c or methylated C nucleotide
  modified_base (19)..(19): c or methylated C nucleotide
  modified_base (29)..(29): c or methylated C nucleotide
ctgcgcgccatcgggccccgccccaccccgg

SEQ ID NO: 679 - DNA, 32 bp, Artificial
  synthetic oligonucleotide
  modified_base (5)..(5): c or methylated C nucleotide
  modified_base (7)..(7): c or methylated C nucleotide
  modified_base (13)..(13): c or methylated C nucleotide
  modified_base (20)..(20): c or methylated C nucleotide
  modified_base (30)..(30): c or methylated C nucleotide
gctgcgcgccatcgggccccgccccaccccgg

SEQ ID NO: 680 - DNA, 33 bp, Artificial
  synthetic oligonucleotide
  modified_base (6)..(6): c or methylated C nucleotide
  modified_base (8)..(8): c or methylated C nucleotide
  modified_base (14)..(14): c or methylated C nucleotide
  modified_base (21)..(21): c or methylated C nucleotide
  modified_base (31)..(31): c or methylated C nucleotide
ggctgcgcgccatcgggccccgccccaccccgg

SEQ ID NO: 681 - DNA, 34 bp, Artificial
  synthetic oligonucleotide
  modified_base (7)..(7): c or methylated C nucleotide
  modified_base (9)..(9): c or methylated C nucleotide
  modified_base (15)..(15): c or methylated C nucleotide
  modified_base (22)..(22): c or methylated C nucleotide
  modified_base (32)..(32): c or methylated C nucleotide
tggctgcgcgccatcgggccccgccccaccccgg

SEQ ID NO: 682 - DNA, 30 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (26)..(26): c or methylated C nucleotide
gcgcgccatcgggccccgccccaccccggt

SEQ ID NO: 683 - DNA, 31 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggtt

SEQ ID NO: 684 - DNA, 32 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggttg

SEQ ID NO: 685 - DNA, 33 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggttgg

SEQ ID NO: 686 - DNA, 34 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggttggc

SEQ ID NO: 687 - DNA, 31 bp, Artificial
  synthetic oligonucleotide
  modified_base (3)..(3): c or methylated C nucleotide
  modified_base (5)..(5): c or methylated C nucleotide
  modified_base (11)..(11): c or methylated C nucleotide
  modified_base (18)..(18): c or methylated C nucleotide
  modified_base (28)..(28): c or methylated C nucleotide
tgcgcgccatcgggccccgccccaccccggt

SEQ ID NO: 688 - DNA, 33 bp, Artificial
  synthetic oligonucleotide
  modified_base (4)..(4): c or methylated C nucleotide
  modified_base (6)..(6): c or methylated C nucleotide
  modified_base (12)..(12): c or methylated C nucleotide
  modified_base (19)..(19): c or methylated C nucleotide
  modified_base (29)..(29): c or methylated C nucleotide
ctgcgcgccatcgggccccgccccaccccggtt

SEQ ID NO: 689 - DNA, 35 bp, Artificial
  synthetic oligonucleotide
  modified_base (5)..(5): c or methylated C nucleotide
  modified_base (7)..(7): c or methylated C nucleotide
  modified_base (13)..(13): c or methylated C nucleotide
  modified_base (20)..(20): c or methylated C nucleotide
  modified_base (30)..(30): c or methylated C nucleotide
gctgcgcgccatcgggccccgccccaccccggttg

SEQ ID NO: 690 - DNA, 37 bp, Artificial
  synthetic oligonucleotide
  modified_base (6)..(6): c or methylated C nucleotide
  modified_base (8)..(8): c or methylated C nucleotide
  modified_base (14)..(14): c or methylated C nucleotide
  modified_base (21)..(21): c or methylated C nucleotide
  modified_base (31)..(31): c or methylated C nucleotide
ggctgcgcgccatcgggccccgccccaccccggttgg

SEQ ID NO: 691 - DNA, 39 bp, Artificial
  synthetic oligonucleotide
  modified_base (7)..(7): c or methylated C nucleotide
  modified_base (9)..(9): c or methylated C nucleotide
  modified_base (15)..(15): c or methylated C nucleotide
  modified_base (22)..(22): c or methylated C nucleotide
  modified_base (32)..(32): c or methylated C nucleotide
tggctgcgcgccatcgggccccgccccaccccggttggc

SEQ ID NO: 692 - DNA, 29 bp, Artificial
  synthetic oligonucleotide
  modified_base (5)..(5): c or methylated C nucleotide
  modified_base (7)..(7): c or methylated C nucleotide
  modified_base (13)..(13): c or methylated C nucleotide
  modified_base (20)..(20): c or methylated C nucleotide
gctgcgcgccatcgggccccgccccaccc

SEQ ID NO: 693 - DNA, 29 bp, Artificial
  synthetic oligonucleotide
  modified_base (8)..(8): c or methylated C nucleotide
  modified_base (10)..(10): c or methylated C nucleotide
  modified_base (16)..(16): c or methylated C nucleotide
  modified_base (23)..(23): c or methylated C nucleotide
ttggctgcgcgccatcgggccccgcccca

SEQ ID NO: 694 - DNA, 29 bp, Artificial
  synthetic oligonucleotide
  modified_base (11)..(11): c or methylated C nucleotide
  modified_base (13)..(13): c or methylated C nucleotide
  modified_base (19)..(19): c or methylated C nucleotide
  modified_base (26)..(26): c or methylated C nucleotide
ccattggctgcgcgccatcgggccccgcc

SEQ ID NO: 695 - DNA, 29 bp, Artificial
  synthetic oligonucleotide
  modified_base (14)..(14): c or methylated C nucleotide
  modified_base (16)..(16): c or methylated C nucleotide
  modified_base (22)..(22): c or methylated C nucleotide
  modified_base (29)..(29): c or methylated C nucleotide
ctaccattggctgcgcgccatcgggcccc

SEQ ID NO: 696 - DNA, 29 bp, Artificial
  synthetic oligonucleotide
  modified_base (17)..(17): c or methylated C nucleotide
  modified_base (19)..(19): c or methylated C nucleotide
  modified_base (25)..(25): c or methylated C nucleotide
ggcctaccattggctgcgcgccatcgggc

SEQ ID NO: 697 - DNA, 29 bp, Artificial
  synthetic oligonucleotide
  modified_base (1)..(1): c or methylated C nucleotide
  modified_base (7)..(7): c or methylated C nucleotide
  modified_base (14)..(14): c or methylated C nucleotide
  modified_base (24)..(24): c or methylated C nucleotide
cgccatcgggccccgccccaccccggttg

SEQ ID NO: 698 - DNA, 29 bp, Artificial
  synthetic oligonucleotide
  modified_base (4)..(4): c or methylated C nucleotide
  modified_base (11)..(11): c or methylated C nucleotide
  modified_base (21)..(21): c or methylated C nucleotide
catcgggccccgccccaccccggttggct

SEQ ID NO: 699 - DNA, 29 bp, Artificial
  synthetic oligonucleotide
  modified_base (1)..(1): c or methylated C nucleotide
  modified_base (8)..(8): c or methylated C nucleotide
  modified_base (18)..(18): c or methylated C nucleotide
cgggccccgccccaccccggttggctgag

SEQ ID NO: 700 - DNA, 29 bp, Artificial
  synthetic oligonucleotide
  modified_base (5)..(5): c or methylated C nucleotide
  modified_base (15)..(15): c or methylated C nucleotide
gccccgccccaccccggttggctgagcgg

SEQ ID NO: 701 - DNA, 29 bp, Artificial
  synthetic oligonucleotide
  modified_base (2)..(2): c or methylated C nucleotide
  modified_base (12)..(12): c or methylated C nucleotide
ccgccccaccccggttggctgagcggccc

SEQ ID NO: 702 - DNA, 27 bp, Artificial
  synthetic oligonucleotide
  modified_base (2)..(2): c or methylated C nucleotide
  modified_base (8)..(8): c or methylated C nucleotide
  modified_base (15)..(15): c or methylated C nucleotide
  modified_base (25)..(25): c or methylated C nucleotide
gcgccatcgggccccgccccaccccgg

SEQ ID NO: 703 - DNA, 25 bp, Artificial
  synthetic oligonucleotide
  modified_base (6)..(6): c or methylated C nucleotide
  modified_base (13)..(13): c or methylated C nucleotide
  modified_base (23)..(23): c or methylated C nucleotide
gccatcgggccccgccccaccccgg

SEQ ID NO: 704 - DNA, 23 bp, Artificial
  synthetic oligonucleotide
  modified_base (4)..(4): c or methylated C nucleotide
  modified_base (11)..(11): c or methylated C nucleotide
  modified_base (21)..(21): c or methylated C nucleotide
catcgggccccgccccaccccgg

SEQ ID NO: 705 - DNA, 21 bp, Artificial
  synthetic oligonucleotide
  modified_base (2)..(2): c or methylated C nucleotide
  modified_base (9)..(9): c or methylated C nucleotide
  modified_base (19)..(19): c or methylated C nucleotide
tcgggccccgccccaccccgg

SEQ ID NO: 706 - DNA, 19 bp, Artificial
  synthetic oligonucleotide
  modified_base (7)..(7): c or methylated C nucleotide
  modified_base (17)..(17): c or methylated C nucleotide
gggccccgccccaccccgg

SEQ ID NO: 707 - DNA, 17 bp, Artificial
  synthetic oligonucleotide
  modified_base (5)..(5): c or methylated C nucleotide
  modified_base (15)..(15): c or methylated C nucleotide
gccccgccccaccccgg

SEQ ID NO: 708 - DNA, 15 bp, Artificial
  synthetic oligonucleotide
  modified_base (3)..(3): c or methylated C nucleotide
  modified_base (13)..(13): c or methylated C nucleotide
cccgccccaccccgg

SEQ ID NO: 709 - DNA, 27 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccacccc

SEQ ID NO: 710 - DNA, 25 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgccccacc

SEQ ID NO: 711 - DNA, 23 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgcccca

SEQ ID NO: 712 - DNA, 21 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgccc

SEQ ID NO: 713 - DNA, 19 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgc

SEQ ID NO: 714 - DNA, 17 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggcccc

SEQ ID NO: 715 - DNA, 15 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
gcgcgccatcgggcc

SEQ ID NO: 716 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggcaccgccccaccccgg

SEQ ID NO: 717 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccctaccccgg

SEQ ID NO: 718 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgcgatcgggccccgccccaccccgg

SEQ ID NO: 719 - DNA, 40 bp, Artificial; identical to SEQ ID NO: 469
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide

SEQ ID NO: 720 - DNA, 41 bp, Artificial
  synthetic oligonucleotide
  modified_base (14)..(14): c or methylated C nucleotide
  modified_base (16)..(16): c or methylated C nucleotide
  modified_base (18)..(18): c or methylated C nucleotide
  modified_base (23)..(23): c or methylated C nucleotide
  modified_base (28)..(28): c or methylated C nucleotide
  modified_base (30)..(30): c or methylated C nucleotide
gcgggggcgggggcgcgcggttcgccccgcgcatgggctcc

SEQ ID NO: 721 - DNA, 42 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
  modified_base (24)..(24): c or methylated C nucleotide
  modified_base (29)..(29): c or methylated C nucleotide
  modified_base (31)..(31): c or methylated C nucleotide
ggcgggggcgggggcgcgcggttcgccccgcgcatgggctcc

SEQ ID NO: 722 - DNA, 43 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (25)..(25): c or methylated C nucleotide
  modified_base (30)..(30): c or methylated C nucleotide
  modified_base (32)..(32): c or methylated C nucleotide
gggcgggggcgggggcgcgcggttcgccccgcgcatgggctcc

SEQ ID NO: 723 - DNA, 44 bp, Artificial
  synthetic oligonucleotide
  modified_base (17)..(17): c or methylated C nucleotide
  modified_base (19)..(19): c or methylated C nucleotide
  modified_base (21)..(21): c or methylated C nucleotide
  modified_base (26)..(26): c or methylated C nucleotide
  modified_base (31)..(31): c or methylated C nucleotide
  modified_base (33)..(33): c or methylated C nucleotide
cgggcgggggcgggggcgcgcggttcgccccgcgcatgggctcc

SEQ ID NO: 724 - DNA, 45 bp, Artificial
  synthetic oligonucleotide
  modified_base (18)..(18): c or methylated C nucleotide
  modified_base (20)..(20): c or methylated C nucleotide
  modified_base (22)..(22): c or methylated C nucleotide
  modified_base (27)..(27): c or methylated C nucleotide
  modified_base (32)..(32): c or methylated C nucleotide
  modified_base (34)..(34): c or methylated C nucleotide
gcgggcgggggcgggggcgcgcggttcgccccgcgcatgggctcc

SEQ ID NO: 725 - DNA, 41 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccg

SEQ ID NO: 726 - DNA, 42 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgt

SEQ ID NO: 727 - DNA, 43 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgtc

SEQ ID NO: 728 - DNA, 44 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgtcc

SEQ ID NO: 729 - DNA, 45 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgtccg

SEQ ID NO: 730 - DNA, 42 bp, Artificial
  synthetic oligonucleotide
  modified_base (14)..(14): c or methylated C nucleotide
  modified_base (16)..(16): c or methylated C nucleotide
  modified_base (18)..(18): c or methylated C nucleotide
  modified_base (23)..(23): c or methylated C nucleotide
  modified_base (28)..(28): c or methylated C nucleotide
  modified_base (30)..(30): c or methylated C nucleotide
gcgggggcgggggcgcgcggttcgccccgcgcatgggctccg

SEQ ID NO: 731 - DNA, 44 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
  modified_base (24)..(24): c or methylated C nucleotide
  modified_base (29)..(29): c or methylated C nucleotide
  modified_base (31)..(31): c or methylated C nucleotide
ggcgggggcgggggcgcgcggttcgccccgcgcatgggctccgt

SEQ ID NO: 732 - DNA, 46 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (25)..(25): c or methylated C nucleotide
  modified_base (30)..(30): c or methylated C nucleotide
  modified_base (32)..(32): c or methylated C nucleotide
gggcgggggcgggggcgcgcggttcgccccgcgcatgggctccgtc

SEQ ID NO: 733 - DNA, 48 bp, Artificial
  synthetic oligonucleotide
  modified_base (17)..(17): c or methylated C nucleotide
  modified_base (19)..(19): c or methylated C nucleotide
  modified_base (21)..(21): c or methylated C nucleotide
  modified_base (26)..(26): c or methylated C nucleotide
  modified_base (31)..(31): c or methylated C nucleotide
  modified_base (33)..(33): c or methylated C nucleotide
cgggcgggggcgggggcgcgcggttcgccccgcgcatgggctccgtcc

SEQ ID NO: 734 - DNA, 50 bp, Artificial
  synthetic oligonucleotide
  modified_base (18)..(18): c or methylated C nucleotide
  modified_base (20)..(20): c or methylated C nucleotide
  modified_base (22)..(22): c or methylated C nucleotide
  modified_base (27)..(27): c or methylated C nucleotide
  modified_base (32)..(32): c or methylated C nucleotide
  modified_base (34)..(34): c or methylated C nucleotide
gcgggcgggggcgggggcgcgcggttcgccccgcgcatgggctccgtccg

SEQ ID NO: 735 - DNA, 40 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (25)..(25): c or methylated C nucleotide
  modified_base (30)..(30): c or methylated C nucleotide
  modified_base (32)..(32): c or methylated C nucleotide
gggcgggggcgggggcgcgcggttcgccccgcgcatgggc

SEQ ID NO: 736 - DNA, 40 bp, Artificial
  synthetic oligonucleotide
  modified_base (19)..(19): c or methylated C nucleotide
  modified_base (21)..(21): c or methylated C nucleotide
  modified_base (23)..(23): c or methylated C nucleotide
  modified_base (28)..(28): c or methylated C nucleotide
  modified_base (33)..(33): c or methylated C nucleotide
  modified_base (35)..(35): c or methylated C nucleotide
ggcgggcgggggcgggggcgcgcggttcgccccgcgcatg

SEQ ID NO: 737 - DNA, 40 bp, Artificial
  synthetic oligonucleotide
  modified_base (22)..(22): c or methylated C nucleotide
  modified_base (24)..(24): c or methylated C nucleotide
  modified_base (26)..(26): c or methylated C nucleotide
  modified_base (31)..(31): c or methylated C nucleotide
  modified_base (36)..(36): c or methylated C nucleotide
  modified_base (38)..(38): c or methylated C nucleotide
gggggcgggcgggggcgggggcgcgcggttcgccccgcgc

SEQ ID NO: 738 - DNA, 40 bp, Artificial
  synthetic oligonucleotide
  modified_base (25)..(25): c or methylated C nucleotide
  modified_base (27)..(27): c or methylated C nucleotide
  modified_base (29)..(29): c or methylated C nucleotide
  modified_base (34)..(34): c or methylated C nucleotide
  modified_base (39)..(39): c or methylated C nucleotide
ggcgggggcgggcgggggcgggggcgcgcggttcgccccg

SEQ ID NO: 739 - DNA, 40 bp, Artificial
  synthetic oligonucleotide
  modified_base (26)..(26): c or methylated C nucleotide
  modified_base (30)..(30): c or methylated C nucleotide
  modified_base (32)..(32): c or methylated C nucleotide
  modified_base (37)..(37): c or methylated C nucleotide
cggggcgggggcgggcgggggcgggggcgcgcggttcgcc

SEQ ID NO: 740 - DNA, 40 bp, Artificial
  synthetic oligonucleotide
  modified_base (10)..(10): c or methylated C nucleotide
  modified_base (12)..(12): c or methylated C nucleotide
  modified_base (14)..(14): c or methylated C nucleotide
  modified_base (19)..(19): c or methylated C nucleotide
  modified_base (24)..(24): c or methylated C nucleotide
  modified_base (26)..(26): c or methylated C nucleotide
gggcgggggcgcgcggttcgccccgcgcatgggctccgtc

SEQ ID NO: 741 - DNA, 40 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatgggctccgtccgc

SEQ ID NO: 742 - DNA, 40 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgcatgggctccgtccgcggc

SEQ ID NO: 743 - DNA, 40 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcgcatgggctccgtccgcggcggg

SEQ ID NO: 744 - DNA, 40 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (14)..(14): c or methylated C nucleotide
gcggttcgccccgcgcatgggctccgtccgcggcgggtgc

SEQ ID NO: 745 - DNA, 38 bp, Artificial
  synthetic oligonucleotide
  modified_base (11)..(11): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
ggggcgggggcgcgcggttcgccccgcgcatgggctcc

SEQ ID NO: 746 - DNA, 36 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
ggcgggggcgcgcggttcgccccgcgcatgggctcc

SEQ ID NO: 747 - DNA, 34 bp, Artificial; identical to SEQ ID NO: 518
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide

SEQ ID NO: 748 - DNA, 32 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgcatgggctcc

SEQ ID NO: 749 - DNA, 30 bp, Artificial; identical to SEQ ID NO: 513
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide

SEQ ID NO: 750 - DNA, 28 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcgcatgggctcc

SEQ ID NO: 751 - DNA, 26 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
cgcggttcgccccgcgcatgggctcc

SEQ ID NO: 752 - DNA, 24 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatgggctcc

SEQ ID NO: 753 - DNA, 22 bp, Artificial
  synthetic oligonucleotide
  modified_base (4)..(4): c or methylated C nucleotide
  modified_base (9)..(9): c or methylated C nucleotide
  modified_base (11)..(11): c or methylated C nucleotide
gttcgccccgcgcatgggctcc

SEQ ID NO: 754 - DNA, 20 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
tcgccccgcgcatgggctcc

SEQ ID NO: 755 - DNA, 18 bp, Artificial
  synthetic oligonucleotide
  modified_base (5)..(5): c or methylated C nucleotide
  modified_base (7)..(7): c or methylated C nucleotide
gccccgcgcatgggctcc

SEQ ID NO: 756 - DNA, 16 bp, Artificial
  synthetic oligonucleotide
  modified_base (3)..(3): c or methylated C nucleotide
  modified_base (5)..(5): c or methylated C nucleotide
cccgcgcatgggctcc

SEQ ID NO: 757 - DNA, 15 bp, Artificial
  synthetic oligonucleotide
  modified_base (3)..(3): c or methylated C nucleotide
  modified_base (5)..(5): c or methylated C nucleotide
cccgcgcatgggctc

SEQ ID NO: 758 - DNA, 38 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggct

SEQ ID NO: 759 - DNA, 36 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatggg

SEQ ID NO: 760 - DNA, 34 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatg

SEQ ID NO: 761 - DNA, 32 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgca

SEQ ID NO: 762 - DNA, 30 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcg

SEQ ID NO: 763 - DNA, 28 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
cgggggcgggggcgcgcggttcgccccg

SEQ ID NO: 764 - DNA, 26 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
cgggggcgggggcgcgcggttcgccc

SEQ ID NO: 765 - DNA, 24 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
cgggggcgggggcgcgcggttcgc

SEQ ID NO: 766 - DNA, 22 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
cgggggcgggggcgcgcggttc

SEQ ID NO: 767 - DNA, 20 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
cgggggcgggggcgcgcggt

SEQ ID NO: 768 - DNA, 18 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
cgggggcgggggcgcgcg

SEQ ID NO: 769 - DNA, 16 bp, Artificial
  synthetic oligonucleotide
  modified_base (13)..(13): c or methylated C nucleotide
  modified_base (15)..(15): c or methylated C nucleotide
cgggggcgggggcgcg

SEQ ID NO: 770 - DNA, 15 bp, Artificial
  synthetic oligonucleotide
  modified_base (13)..(13): c or methylated C nucleotide
  modified_base (15)..(15): c or methylated C nucleotide
cgggggcgggggcgc

SEQ ID NO: 771 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcaggggcgcgcggttcgccccgcgcatgggctcc

SEQ ID NO: 772 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcgtttcgccccgcgcatgggctcc

SEQ ID NO: 773 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcacatgggctcc

SEQ ID NO: 774 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcg

SEQ ID NO: 775 - DNA, 21 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcg

SEQ ID NO: 776 - DNA, 22 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcg

SEQ ID NO: 777 - DNA, 23 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcg

SEQ ID NO: 778 - DNA, 24 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcg

SEQ ID NO: 779 - DNA, 25 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcg

SEQ ID NO: 780 - DNA, 21 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgc

SEQ ID NO: 781 - DNA, 22 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgca

SEQ ID NO: 782 - DNA, 23 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcat

SEQ ID NO: 783 - DNA, 24 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatg

SEQ ID NO: 784 - DNA, 25 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgg

SEQ ID NO: 785 - DNA, 22 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgc

SEQ ID NO: 786 - DNA, 24 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgca

SEQ ID NO: 787 - DNA, 26 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcat

SEQ ID NO: 788 - DNA, 28 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatg

SEQ ID NO: 789 - DNA, 30 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcgcatgg

SEQ ID NO: 790 - DNA, 20 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
gggggcgcgcggttcgcccc

SEQ ID NO: 791 - DNA, 20 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (18)..(18): c or methylated C nucleotide
ggcgggggcgcgcggttcgc

SEQ ID NO: 792 - DNA, 20 bp, Artificial
  synthetic oligonucleotide
  modified_base (12)..(12): c or methylated C nucleotide
  modified_base (14)..(14): c or methylated C nucleotide
  modified_base (16)..(16): c or methylated C nucleotide
gggggcgggggcgcgcggtt

SEQ ID NO: 793 - DNA, 20 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
ggcgggggcgggggcgcgcg

SEQ ID NO: 794 - DNA, 20 bp, Artificial
  synthetic oligonucleotide
  modified_base (18)..(18): c or methylated C nucleotide
  modified_base (20)..(20): c or methylated C nucleotide
cggggcgggggcgggggcgc

SEQ ID NO: 795 - DNA, 20 bp, Artificial
  synthetic oligonucleotide
  modified_base (2)..(2): c or methylated C nucleotide
  modified_base (4)..(4): c or methylated C nucleotide
  modified_base (9)..(9): c or methylated C nucleotide
  modified_base (14)..(14): c or methylated C nucleotide
  modified_base (16)..(16): c or methylated C nucleotide
gcgcggttcgccccgcgcat

SEQ ID NO: 796 - DNA, 20 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatggg

SEQ ID NO: 797 - DNA, 20 bp, Artificial
  synthetic oligonucleotide
  modified_base (3)..(3): c or methylated C nucleotide
  modified_base (8)..(8): c or methylated C nucleotide
  modified_base (10)..(10): c or methylated C nucleotide
ttcgccccgcgcatgggctc

SEQ ID NO: 798 - DNA, 20 bp, Artificial
  synthetic oligonucleotide
  modified_base (5)..(5): c or methylated C nucleotide
  modified_base (7)..(7): c or methylated C nucleotide
gccccgcgcatgggctccgt

SEQ ID NO: 799 - DNA, 20 bp, Artificial
  synthetic oligonucleotide
  modified_base (2)..(2): c or methylated C nucleotide
  modified_base (4)..(4): c or methylated C nucleotide
ccgcgcatgggctccgtccg

SEQ ID NO: 800 - DNA, 18 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcg

SEQ ID NO: 801 - DNA, 16 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
cgcggttcgccccgcg

SEQ ID NO: 802 - DNA, 15 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (14)..(14): c or methylated C nucleotide
gcggttcgccccgcg

SEQ ID NO: 803 - DNA, 18 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
ggcgcgcggttcgccccg

SEQ ID NO: 804 - DNA, 16 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgccc

SEQ ID NO: 805 - DNA, 15 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgcc

SEQ ID NO: 806 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcacggttcgccccgcg

SEQ ID NO: 807 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgtcccgcg

SEQ ID NO: 808 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccgcgcg

SEQ ID NO: 809 - DNA, 26 bp, Artificial
  synthetic oligonucleotide
ggcgcgcggttcgccccgcgcatggg

SEQ ID NO: 810 - DNA, 27 bp, Artificial
  synthetic oligonucleotide
gggcgcgcggttcgccccgcgcatggg

SEQ ID NO: 811 - DNA, 28 bp, Artificial
  synthetic oligonucleotide
ggggcgcgcggttcgccccgcgcatggg

SEQ ID NO: 812 - DNA, 29 bp, Artificial
  synthetic oligonucleotide
gggggcgcgcggttcgccccgcgcatggg

SEQ ID NO: 813 - DNA, 30 bp, Artificial; identical to SEQ ID NO: 508
  synthetic oligonucleotide

SEQ ID NO: 814 - DNA, 31 bp, Artificial; identical to SEQ ID NO: 509
  synthetic oligonucleotide

SEQ ID NO: 815 - DNA, 27 bp, Artificial
  synthetic oligonucleotide
ggcgcgcggttcgccccgcgcatgggc

SEQ ID NO: 816 - DNA, 28 bp, Artificial
  synthetic oligonucleotide
ggcgcgcggttcgccccgcgcatgggct

SEQ ID NO: 817 - DNA, 29 bp, Artificial
  synthetic oligonucleotide
ggcgcgcggttcgccccgcgcatgggctc

SEQ ID NO: 818 - DNA, 30 bp, Artificial; identical to SEQ ID NO: 513
  synthetic oligonucleotide

SEQ ID NO: 819 - DNA, 31 bp, Artificial; identical to SEQ ID NO: 514
  synthetic oligonucleotide

SEQ ID NO: 820 - DNA, 28 bp, Artificial
  synthetic oligonucleotide
gggcgcgcggttcgccccgcgcatgggc

SEQ ID NO: 821 - DNA, 30 bp, Artificial; identical to SEQ ID NO: 516
  synthetic oligonucleotide

SEQ ID NO: 822 - DNA, 32 bp, Artificial; identical to SEQ ID NO: 517
  synthetic oligonucleotide

SEQ ID NO: 823 - DNA, 34 bp, Artificial; identical to SEQ ID NO: 518
  synthetic oligonucleotide

SEQ ID NO: 824 - DNA, 36 bp, Artificial; identical to SEQ ID NO: 519
  synthetic oligonucleotide

SEQ ID NO: 825 - DNA, 26 bp, Artificial
  synthetic oligonucleotide
gggggcgcgcggttcgccccgcgcat

SEQ ID NO: 826 - DNA, 26 bp, Artificial
  synthetic oligonucleotide
ggcgggggcgcgcggttcgccccgcg

SEQ ID NO: 827 - DNA, 26 bp, Artificial
  synthetic oligonucleotide
gggggcgggggcgcgcggttcgcccc

SEQ ID NO: 828 - DNA, 26 bp, Artificial
  synthetic oligonucleotide
ggcgggggcgggggcgcgcggttcgc

SEQ ID NO: 829 - DNA, 26 bp, Artificial
  synthetic oligonucleotide
cggggcgggggcgggggcgcgcggtt

SEQ ID NO: 830 - DNA, 26 bp, Artificial
  synthetic oligonucleotide
gcgcggttcgccccgcgcatgggctc

SEQ ID NO: 831 - DNA, 26 bp, Artificial
  synthetic oligonucleotide
cggttcgccccgcgcatgggctccgt

SEQ ID NO: 832 - DNA, 26 bp, Artificial
  synthetic oligonucleotide
ttcgccccgcgcatgggctccgtccg

SEQ ID NO: 833 - DNA, 26 bp, Artificial
  synthetic oligonucleotide
gccccgcgcatgggctccgtccgcgg

SEQ ID NO: 834 - DNA, 26 bp, Artificial
  synthetic oligonucleotide
ccgcgcatgggctccgtccgcgggcc

SEQ ID NO: 835 - DNA, 24 bp, Artificial
  synthetic oligonucleotide
cgcgcggttcgccccgcgcatggg

SEQ ID NO: 836 - DNA, 22 bp, Artificial
  synthetic oligonucleotide
cgcggttcgccccgcgcatggg

SEQ ID NO: 837 - DNA, 20 bp, Artificial
  synthetic oligonucleotide
cggttcgccccgcgcatggg

SEQ ID NO: 838 - DNA, 18 bp, Artificial
  synthetic oligonucleotide
gttcgccccgcgcatggg

SEQ ID NO: 839 - DNA, 16 bp, Artificial
  synthetic oligonucleotide
tcgccccgcgcatggg

SEQ ID NO: 840 - DNA, 15 bp, Artificial
  synthetic oligonucleotide
cgccccgcgcatggg

SEQ ID NO: 841 - DNA, 24 bp, Artificial
  synthetic oligonucleotide
ggcgcgcggttcgccccgcgcatg

SEQ ID NO: 842 - DNA, 22 bp, Artificial
  synthetic oligonucleotide
ggcgcgcggttcgccccgcgca

SEQ ID NO: 843 - DNA, 20 bp, Artificial
  synthetic oligonucleotide
ggcgcgcggttcgccccgcg

SEQ ID NO: 844 - DNA, 18 bp, Artificial
  synthetic oligonucleotide
ggcgcgcggttcgccccg

SEQ ID NO: 845 - DNA, 16 bp, Artificial
  synthetic oligonucleotide
ggcgcgcggttcgccc

SEQ ID NO: 846 - DNA, 15 bp, Artificial
  synthetic oligonucleotide
ggcgcgcggttcgcc

SEQ ID NO: 847 - DNA, 26 bp, Artificial
  synthetic oligonucleotide
ggcgcgctgttcgccccgcgcatggg

SEQ ID NO: 848 - DNA, 26 bp, Artificial
  synthetic oligonucleotide
ggcgcgcggttcgccccgcgcctggg

SEQ ID NO: 849 - DNA, 26 bp, Artificial
  synthetic oligonucleotide
ggcgcgcggttcgacccgcgcatggg

SEQ ID NO: 850 - DNA, 31 bp, Artificial; identical to SEQ ID NO: 474
  synthetic oligonucleotide
  modified_base (3)..(3): c or methylated C nucleotide
  modified_base (7)..(7): c or methylated C nucleotide
  modified_base (19)..(19): c or methylated C nucleotide

SEQ ID NO: 851 - DNA, 32 bp, Artificial
  synthetic oligonucleotide
  modified_base (4)..(4): c or methylated C nucleotide
  modified_base (8)..(8): c or methylated C nucleotide
  modified_base (20)..(20): c or methylated C nucleotide
cagcgtgcgggagggctgtcgcctcgccccca

SEQ ID NO: 852 - DNA, 33 bp, Artificial
  synthetic oligonucleotide
  modified_base (5)..(5): c or methylated C nucleotide
  modified_base (9)..(9): c or methylated C nucleotide
  modified_base (21)..(21): c or methylated C nucleotide
ccagcgtgcgggagggctgtcgcctcgccccca

SEQ ID NO: 853 - DNA, 34 bp, Artificial
  synthetic oligonucleotide
  modified_base (6)..(6): c or methylated C nucleotide
  modified_base (10)..(10): c or methylated C nucleotide
  modified_base (22)..(22): c or methylated C nucleotide
cccagcgtgcgggagggctgtcgcctcgccccca

SEQ ID NO: 854 - DNA, 35 bp, Artificial
  synthetic oligonucleotide
  modified_base (7)..(7): c or methylated C nucleotide
  modified_base (11)..(11): c or methylated C nucleotide
  modified_base (23)..(23): c or methylated C nucleotide
acccagcgtgcgggagggctgtcgcctcgccccca

SEQ ID NO: 855 - DNA, 36 bp, Artificial
  synthetic oligonucleotide
  modified_base (8)..(8): c or methylated C nucleotide
  modified_base (12)..(12): c or methylated C nucleotide
  modified_base (24)..(24): c or methylated C nucleotide
aacccagcgtgcgggagggctgtcgcctcgccccca

SEQ ID NO: 856 - DNA, 32 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccac

SEQ ID NO: 857 - DNA, 33 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccact

SEQ ID NO: 858 - DNA, 34 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccactt

SEQ ID NO: 859 - DNA, 35 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccacttg

SEQ ID NO: 860 - DNA, 36 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccacttgc

SEQ ID NO: 861 - DNA, 33 bp, Artificial
  synthetic oligonucleotide
  modified_base (4)..(4): c or methylated C nucleotide
  modified_base (8)..(8): c or methylated C nucleotide
  modified_base (20)..(20): c or methylated C nucleotide
cagcgtgcgggagggctgtcgcctcgcccccac

SEQ ID NO: 862 - DNA, 35 bp, Artificial
  synthetic oligonucleotide
  modified_base (5)..(5): c or methylated C nucleotide
  modified_base (9)..(9): c or methylated C nucleotide
  modified_base (21)..(21): c or methylated C nucleotide
ccagcgtgcgggagggctgtcgcctcgcccccact

SEQ ID NO: 863 - DNA, 37 bp, Artificial
  synthetic oligonucleotide
  modified_base (6)..(6): c or methylated C nucleotide
  modified_base (10)..(10): c or methylated C nucleotide
  modified_base (22)..(22): c or methylated C nucleotide
cccagcgtgcgggagggctgtcgcctcgcccccactt

SEQ ID NO: 864 - DNA, 39 bp, Artificial
  synthetic oligonucleotide
  modified_base (7)..(7): c or methylated C nucleotide
  modified_base (11)..(11): c or methylated C nucleotide
  modified_base (23)..(23): c or methylated C nucleotide
acccagcgtgcgggagggctgtcgcctcgcccccacttg

SEQ ID NO: 865 - DNA, 41 bp, Artificial
  synthetic oligonucleotide
  modified_base (8)..(8): c or methylated C nucleotide
  modified_base (12)..(12): c or methylated C nucleotide
  modified_base (24)..(24): c or methylated C nucleotide
aacccagcgtgcgggagggctgtcgcctcgcccccacttgc

SEQ ID NO: 866 - DNA, 31 bp, Artificial
  synthetic oligonucleotide
  modified_base (6)..(6): c or methylated C nucleotide
  modified_base (10)..(10): c or methylated C nucleotide
  modified_base (22)..(22): c or methylated C nucleotide
cccagcgtgcgggagggctgtcgcctcgccc

SEQ ID NO: 867 - DNA, 31 bp, Artificial
  synthetic oligonucleotide
  modified_base (9)..(9): c or methylated C nucleotide
  modified_base (13)..(13): c or methylated C nucleotide
  modified_base (25)..(25): c or methylated C nucleotide
caacccagcgtgcgggagggctgtcgcctcg

SEQ ID NO: 868 - DNA, 31 bp, Artificial
  synthetic oligonucleotide
  modified_base (12)..(12): c or methylated C nucleotide
  modified_base (16)..(16): c or methylated C nucleotide
  modified_base (28)..(28): c or methylated C nucleotide
ctgcaacccagcgtgcgggagggctgtcgcc

SEQ ID NO: 869 - DNA, 31 bp, Artificial
  synthetic oligonucleotide
  modified_base (15)..(15): c or methylated C nucleotide
  modified_base (19)..(19): c or methylated C nucleotide
  modified_base (31)..(31): c or methylated C nucleotide
cagctgcaacccagcgtgcgggagggctgtc

SEQ ID NO: 870 - DNA, 31 bp, Artificial
  synthetic oligonucleotide
  modified_base (18)..(18): c or methylated C nucleotide
  modified_base (22)..(22): c or methylated C nucleotide
gtgcagctgcaacccagcgtgcgggagggct

SEQ ID NO: 871 - DNA, 31 bp, Artificial
  synthetic oligonucleotide
  modified_base (4)..(4): c or methylated C nucleotide
  modified_base (16)..(16): c or methylated C nucleotide
gtgcgggagggctgtcgcctcgcccccactt

SEQ ID NO: 872 - DNA, 31 bp, Artificial
  synthetic oligonucleotide
  modified_base (1)..(1): c or methylated C nucleotide
  modified_base (13)..(13): c or methylated C nucleotide
cgggagggctgtcgcctcgcccccacttgct

SEQ ID NO: 873 - DNA, 31 bp, Artificial
  synthetic oligonucleotide
  modified_base (10)..(10): c or methylated C nucleotide
gagggctgtcgcctcgcccccacttgctctt

SEQ ID NO: 874 - DNA, 31 bp, Artificial
  synthetic oligonucleotide
  modified_base (7)..(7): c or methylated C nucleotide
ggctgtcgcctcgcccccacttgctcttaat

SEQ ID NO: 875 - DNA, 31 bp, Artificial
  synthetic oligonucleotide
  modified_base (4)..(4): c or methylated C nucleotide
tgtcgcctcgcccccacttgctcttaatgac

SEQ ID NO: 876 - DNA, 29 bp, Artificial
  synthetic oligonucleotide
  modified_base (1)..(1): c or methylated C nucleotide
  modified_base (5)..(5): c or methylated C nucleotide
  modified_base (17)..(17): c or methylated C nucleotide
cgtgcgggagggctgtcgcctcgccccca

SEQ ID NO: 877 - DNA, 27 bp, Artificial
  synthetic oligonucleotide
  modified_base (3)..(3): c or methylated C nucleotide
  modified_base (15)..(15): c or methylated C nucleotide
tgcgggagggctgtcgcctcgccccca

SEQ ID NO: 878 - DNA, 25 bp, Artificial
  synthetic oligonucleotide
  modified_base (1)..(1): c or methylated C nucleotide
  modified_base (13)..(13): c or methylated C nucleotide
cgggagggctgtcgcctcgccccca

SEQ ID NO: 879 - DNA, 23 bp, Artificial
  synthetic oligonucleotide
  modified_base (11)..(11): c or methylated C nucleotide
ggagggctgtcgcctcgccccca

SEQ ID NO: 880 - DNA, 21 bp, Artificial
  synthetic oligonucleotide
  modified_base (9)..(9): c or methylated C nucleotide
agggctgtcgcctcgccccca

SEQ ID NO: 881 - DNA, 19 bp, Artificial
  synthetic oligonucleotide
  modified_base (7)..(7): c or methylated C nucleotide
ggctgtcgcctcgccccca

SEQ ID NO: 882 - DNA, 17 bp, Artificial
  synthetic oligonucleotide
  modified_base (5)..(5): c or methylated C nucleotide
ctgtcgcctcgccccca

SEQ ID NO: 883 - DNA, 15 bp, Artificial
  synthetic oligonucleotide
  modified_base (3)..(3): c or methylated C nucleotide
gtcgcctcgccccca

SEQ ID NO: 884 - DNA, 29 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccc

SEQ ID NO: 885 - DNA, 27 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcc

SEQ ID NO: 886 - DNA, 25 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcg

SEQ ID NO: 887 - DNA, 23 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcct

SEQ ID NO: 888 - DNA, 21 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgc

SEQ ID NO: 889 - DNA, 19 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtc

SEQ ID NO: 890 - DNA, 17 bp, Artificial
  synthetic oligonucleotide
  modified_base (3)..(3): c or methylated C nucleotide
  modified_base (7)..(7): c or methylated C nucleotide
agcgtgcgggagggctg

SEQ ID NO: 891 - DNA, 15 bp, Artificial
  synthetic oligonucleotide
  modified_base (3)..(3): c or methylated C nucleotide
  modified_base (7)..(7): c or methylated C nucleotide
agcgtgcgggagggc

SEQ ID NO: 892 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgagcgggagggctgtcgcctcgccccca

SEQ ID NO: 893 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggatgtcgcctcgccccca

SEQ ID NO: 894 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcgtcgccccca

SEQ ID NO: 895 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggca

SEQ ID NO: 896 - DNA, 27 bp, Artificial
  synthetic oligonucleotide
  modified_base (3)..(3): c or methylated C nucleotide
  modified_base (8)..(8): c or methylated C nucleotide
  modified_base (15)..(15): c or methylated C nucleotide
  modified_base (19)..(19): c or methylated C nucleotide
tgcggctcgggttgcgggcgcagggca

SEQ ID NO: 897 - DNA, 28 bp, Artificial
  synthetic oligonucleotide
  modified_base (4)..(4): c or methylated C nucleotide
  modified_base (9)..(9): c or methylated C nucleotide
  modified_base (16)..(16): c or methylated C nucleotide
  modified_base (20)..(20): c or methylated C nucleotide
gtgcggctcgggttgcgggcgcagggca

SEQ ID NO: 898 - DNA, 29 bp, Artificial
  synthetic oligonucleotide
  modified_base (5)..(5): c or methylated C nucleotide
  modified_base (10)..(10): c or methylated C nucleotide
  modified_base (17)..(17): c or methylated C nucleotide
  modified_base (21)..(21): c or methylated C nucleotide
ggtgcggctcgggttgcgggcgcagggca

SEQ ID NO: 899 - DNA, 30 bp, Artificial
  synthetic oligonucleotide
  modified_base (6)..(6): c or methylated C nucleotide
  modified_base (11)..(11): c or methylated C nucleotide
  modified_base (18)..(18): c or methylated C nucleotide
  modified_base (22)..(22): c or methylated C nucleotide
gggtgcggctcgggttgcgggcgcagggca

SEQ ID NO: 900 - DNA, 31 bp, Artificial
  synthetic oligonucleotide
  modified_base (7)..(7): c or methylated C nucleotide
  modified_base (12)..(12): c or methylated C nucleotide
  modified_base (19)..(19): c or methylated C nucleotide
  modified_base (23)..(23): c or methylated C nucleotide
cgggtgcggctcgggttgcgggcgcagggca

SEQ ID NO: 901 - DNA, 27 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcac

SEQ ID NO: 902 - DNA, 28 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacg

SEQ ID NO: 903 - DNA, 29 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacgg

SEQ ID NO: 904 - DNA, 30 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacggg

SEQ ID NO: 905 - DNA, 31 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacgggc

SEQ ID NO: 906 - DNA, 28 bp, Artificial
  synthetic oligonucleotide
  modified_base (3)..(3): c or methylated C nucleotide
  modified_base (8)..(8): c or methylated C nucleotide
  modified_base (15)..(15): c or methylated C nucleotide
  modified_base (19)..(19): c or methylated C nucleotide
tgcggctcgggttgcgggcgcagggcac

SEQ ID NO: 907 - DNA, 30 bp, Artificial
  synthetic oligonucleotide
  modified_base (4)..(4): c or methylated C nucleotide
  modified_base (9)..(9): c or methylated C nucleotide
  modified_base (16)..(16): c or methylated C nucleotide
  modified_base (20)..(20): c or methylated C nucleotide
gtgcggctcgggttgcgggcgcagggcacg

SEQ ID NO: 908 - DNA, 32 bp, Artificial
  synthetic oligonucleotide
  modified_base (5)..(5): c or methylated C nucleotide
  modified_base (10)..(10): c or methylated C nucleotide
  modified_base (17)..(17): c or methylated C nucleotide
  modified_base (21)..(21): c or methylated C nucleotide
ggtgcggctcgggttgcgggcgcagggcacgg

SEQ ID NO: 909 - DNA, 34 bp, Artificial
  synthetic oligonucleotide
  modified_base (6)..(6): c or methylated C nucleotide
  modified_base (11)..(11): c or methylated C nucleotide
  modified_base (18)..(18): c or methylated C nucleotide
  modified_base (22)..(22): c or methylated C nucleotide
gggtgcggctcgggttgcgggcgcagggcacggg

SEQ ID NO: 910 - DNA, 36 bp, Artificial
  synthetic oligonucleotide
  modified_base (7)..(7): c or methylated C nucleotide
  modified_base (12)..(12): c or methylated C nucleotide
  modified_base (19)..(19): c or methylated C nucleotide
  modified_base (23)..(23): c or methylated C nucleotide
cgggtgcggctcgggttgcgggcgcagggcacgggc

SEQ ID NO: 911 - DNA, 26 bp, Artificial
  synthetic oligonucleotide
  modified_base (5)..(5): c or methylated C nucleotide
  modified_base (10)..(10): c or methylated C nucleotide
  modified_base (17)..(17): c or methylated C nucleotide
  modified_base (21)..(21): c or methylated C nucleotide
ggtgcggctcgggttgcgggcgcagg

SEQ ID NO: 912 - DNA, 26 bp, Artificial
  synthetic oligonucleotide
  modified_base (8)..(8): c or methylated C nucleotide
  modified_base (13)..(13): c or methylated C nucleotide
  modified_base (20)..(20): c or methylated C nucleotide
  modified_base (24)..(24): c or methylated C nucleotide
gcgggtgcggctcgggttgcgggcgc

SEQ ID NO: 913 - DNA, 26 bp, Artificial
  synthetic oligonucleotide
  modified_base (11)..(11): c or methylated C nucleotide
  modified_base (16)..(16): c or methylated C nucleotide
  modified_base (23)..(23): c or methylated C nucleotide
gcggcgggtgcggctcgggttgcggg

SEQ ID NO: 914 - DNA, 26 bp, Artificial
  synthetic oligonucleotide
  modified_base (14)..(14): c or methylated C nucleotide
  modified_base (19)..(19): c or methylated C nucleotide
  modified_base (26)..(26): c or methylated C nucleotide
tccgcggcgggtgcggctcgggttgc

SEQ ID NO: 915 - DNA, 26 bp, Artificial
  synthetic oligonucleotide
  modified_base (17)..(17): c or methylated C nucleotide
  modified_base (22)..(22): c or methylated C nucleotide
ccgtccgcggcgggtgcggctcgggt

SEQ ID NO: 916 - DNA, 26 bp, Artificial
  synthetic oligonucleotide
  modified_base (4)..(4): c or methylated C nucleotide
  modified_base (11)..(11): c or methylated C nucleotide
  modified_base (15)..(15): c or methylated C nucleotide
gctcgggttgcgggcgcagggcacgg

SEQ ID NO: 917 - DNA, 26 bp, Artificial
  synthetic oligonucleotide
  modified_base (1)..(1): c or methylated C nucleotide
  modified_base (8)..(8): c or methylated C nucleotide
  modified_base (12)..(12): c or methylated C nucleotide
cgggttgcgggcgcagggcacgggcg

SEQ ID NO: 918 - DNA, 26 bp, Artificial
  synthetic oligonucleotide
  modified_base (5)..(5): c or methylated C nucleotide
  modified_base (9)..(9): c or methylated C nucleotide
gttgcgggcgcagggcacgggcggcg

SEQ ID NO: 919 - DNA, 26 bp, Artificial
  synthetic oligonucleotide
  modified_base (2)..(2): c or methylated C nucleotide
  modified_base (6)..(6): c or methylated C nucleotide
gcgggcgcagggcacgggcggcggag

SEQ ID NO: 920 - DNA, 26 bp, Artificial
  synthetic oligonucleotide
  modified_base (3)..(3): c or methylated C nucleotide
ggcgcagggcacgggcggcggagact

SEQ ID NO: 921 - DNA, 24 bp, Artificial
  synthetic oligonucleotide
  modified_base (5)..(5): c or methylated C nucleotide
  modified_base (12)..(12): c or methylated C nucleotide
  modified_base (16)..(16): c or methylated C nucleotide
ggctcgggttgcgggcgcagggca

SEQ ID NO: 922 - DNA, 22 bp, Artificial
  synthetic oligonucleotide
  modified_base (3)..(3): c or methylated C nucleotide
  modified_base (10)..(10): c or methylated C nucleotide
  modified_base (14)..(14): c or methylated C nucleotide
ctcgggttgcgggcgcagggca

SEQ ID NO: 923 - DNA, 20 bp, Artificial
  synthetic oligonucleotide
  modified_base (1)..(1): c or methylated C nucleotide
  modified_base (8)..(8): c or methylated C nucleotide
  modified_base (12)..(12): c or methylated C nucleotide
cgggttgcgggcgcagggca

SEQ ID NO: 924 - DNA, 18 bp, Artificial
  synthetic oligonucleotide
  modified_base (6)..(6): c or methylated C nucleotide
  modified_base (10)..(10): c or methylated C nucleotide
ggttgcgggcgcagggca

SEQ ID NO: 925 - DNA, 16 bp, Artificial
  synthetic oligonucleotide
  modified_base (4)..(4): c or methylated C nucleotide
  modified_base (8)..(8): c or methylated C nucleotide
ttgcgggcgcagggca

SEQ ID NO: 926 - DNA, 15 bp, Artificial
  synthetic oligonucleotide
  modified_base (3)..(3): c or methylated C nucleotide
  modified_base (7)..(7): c or methylated C nucleotide
tgcgggcgcagggca

SEQ ID NO: 927 - DNA, 24 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcaggg

SEQ ID NO: 928 - DNA, 22 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcag

SEQ ID NO: 929 - DNA, 20 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgc

SEQ ID NO: 930 - DNA, 18 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggc

SEQ ID NO: 931 - DNA, 16 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
gcggctcgggttgcgg

SEQ ID NO: 932 - DNA, 15 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
gcggctcgggttgcg

SEQ ID NO: 933 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcgactcgggttgcgggcgcagggca

SEQ ID NO: 934 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcggtcgcagggca

SEQ ID NO: 935 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttccgggcgcagggca

SEQ ID NO: 936 - DNA, 2824 bp, Homo sapiens
ctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccaggtaagcaccgaagtccacttgccttttaatttatttttttatcactttaatgctgagatgagtcgaatgcctaaatagggtgtcttttctcccattcctgcgctattgacacttttctcagagtagttatggtaactggggctggggtggggggtaatccagaactggatcggggtaaagtgacttgtcaagatgggagaggagaaggcagagggaaaacgggaatggtttttaagactaccctttcgagatttctgccttatgaatatattcacgctgactcccggccggtcggacattcctgctttattgtgttaattgctctctgggttttggggggctgggggttgctttgcggtgggcagaaagccccttgcatcctgagctccttggagtagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattccaacccgccctgatccttttaagaagttggcatttggctttttaaaaagcaataatacaatttaaaacctgggtctctagaggtgttaggacgtggtgttgggtaggcgcaggcaggggaaaagggaggcgaggatgtgtccgattctcctggaatcgttgacttggaaaaaccagggcgaatctccgcacccagccctgactcccctgccgcggccgccctcgggtgtcctcgcgcccgagatgcggaggaactgcgaggagcggggctctgggcggttccagaacagctgctacccttggtggggtggctccgggggaggtatcgcagcggggtctctggcgcagttgcatctccgtattgagtgcgaagggaggtgcccctattattatttgacaccccccttgtatttatggaggggtgttaaagcccgcggctgagctcgccactccagccggcgagagaaagaagaaaagctggcaaaaggagtgttggacgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgcgcactgcgcgctgcgccaggtttccgcaccaagacccctttaactcaagactgcctcccgctttgtgtgccccgctccagcagcctcccgcgacgatgcccctcaacgttagcttcaccaacaggaactatgacctcgactacgactcggtgcagccgtatttctactgcgacgaggaggaga

SEQ ID NO: 937 - DNA, 27 bp, Artificial
  synthetic oligonucleotide
  modified_base (1)..(1): c or methylated C nucleotide
  modified_base (5)..(5): c or methylated C nucleotide
  modified_base (12)..(12): c or methylated C nucleotide
  modified_base (14)..(14): c or methylated C nucleotide
  modified_base (20)..(20): c or methylated C nucleotide
  modified_base (24)..(24): c or methylated C nucleotide
  modified_base (26)..(26): c or methylated C nucleotide
cggccggggcccgcggtggcggccgcg

SEQ ID NO: 938 - DNA, 25 bp, Artificial
  synthetic oligonucleotide
  modified_base (3)..(3): c or methylated C nucleotide
  modified_base (18)..(18): c or methylated C nucleotide
  modified_base (20)..(20): c or methylated C nucleotide
  modified_base (22)..(22): c or methylated C nucleotide
gccgcatgaattaactacgcgcgcc

SEQ ID NO: 939 - DNA, 25 bp, Artificial
  synthetic oligonucleotide
  modified_base (3)..(3): c or methylated C nucleotide
  modified_base (10)..(10): c or methylated C nucleotide
  modified_base (22)..(22): c or methylated C nucleotide
gccggtgggcggagagattagcgag

SEQ ID NO: 940 - DNA, 29 bp, Artificial
  synthetic oligonucleotide
  modified_base (3)..(3): c or methylated C nucleotide
  modified_base (16)..(16): c or methylated C nucleotide
  modified_base (28)..(28): c or methylated C nucleotide
agcgatccctccctccgttctttttcccg

SEQ ID NO: 941 - DNA, 31 bp, Artificial
  synthetic oligonucleotide
  modified_base (2)..(2): c or methylated C nucleotide
  modified_base (29)..(29): c or methylated C nucleotide
tcgcagggggaacagctgccctccacaccga

SEQ ID NO: 942 - DNA, 27 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (21)..(21): c or methylated C nucleotide
  modified_base (23)..(23): c or methylated C nucleotide
  modified_base (25)..(25): c or methylated C nucleotide
tgcgcgcccaccgccagccacgcgcgt

SEQ ID NO: 943 - DNA, 34 bp, Artificial
  synthetic oligonucleotide
  modified_base (4)..(4): c or methylated C nucleotide
  modified_base (9)..(9): c or methylated C nucleotide
  modified_base (30)..(30): c or methylated C nucleotide
  modified_base (32)..(32): c or methylated C nucleotide
gggcgcctcgctaaggctggggaaagggccgcgc

SEQ ID NO: 944 - DNA, 30 bp, Artificial
  synthetic oligonucleotide
ctactcctcgtagtgtttgacaaatcgcat

SEQ ID NO: 945 - DNA, 27 bp, Artificial
  synthetic oligonucleotide
ctcagccgggcagccgagcactctacc

SEQ ID NO: 946 - DNA, 34 bp, Artificial
  synthetic oligonucleotide
ccacgccctctgctttgggaacccgggagggcgc

SEQ ID NO: 947 - DNA, 28 bp, Artificial
  synthetic oligonucleotide
cgagttagataaagccccgaaaatcggc

SEQ ID NO: 948 - DNA, 33 bp, Artificial
  synthetic oligonucleotide
cggctcttccaccctaggcggccgcccgctcgc

SEQ ID NO: 949 - DNA, 24 bp, Artificial
  synthetic oligonucleotide
ggcgaagcccccgattcgctccgg

SEQ ID NO: 950 - DNA, 37 bp, Artificial
  synthetic oligonucleotide
  misc_feature (12)..(12): n is a, c, g, or t
gtctcctcgcgntcgggagactcgcgtccttgctcgg

SEQ ID NO: 951 - DNA, 36 bp, Artificial
  synthetic oligonucleotide
gccgcgggaggtggcggtgaggaatacaatttcccg

SEQ ID NO: 952 - DNA, 36 bp, Artificial
  synthetic oligonucleotide
cgtcggccccgcagcggcagaggaatcgaaagcggc

SEQ ID NO: 953 - DNA, 30 bp, Artificial
  synthetic oligonucleotide
cttggtgcggaaacctggcgcagcgcgcag

SEQ ID NO: 954 - DNA, 25 bp, Artificial
  synthetic oligonucleotide
cagcacagctcgggggtcctcagcc

SEQ ID NO: 955 - DNA, 28 bp, Artificial
  synthetic oligonucleotide
cgtgaatgcggcaaggattgcggaccac

SEQ ID NO: 956 - DNA, 20 bp, Artificial
  synthetic oligonucleotide
gtgaccgccccgtgttatgg

SEQ ID NO: 957 - DNA, 22 bp, Artificial
  synthetic oligonucleotide
gtcgatggcgcaggagtgggag

SEQ ID NO: 958 - DNA, 31 bp, Artificial
  synthetic oligonucleotide
ctgctggagcggggcacacaaagcgggaggc

SEQ ID NO: 959 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcc

SEQ ID NO: 960 - DNA, 27 bp, Artificial
  synthetic oligonucleotide
  modified_base (4)..(4): c or methylated C nucleotide
  modified_base (20)..(20): c or methylated C nucleotide
  modified_base (22)..(22): c or methylated C nucleotide
  modified_base (24)..(24): c or methylated C nucleotide
agccgcattgaattaactacgcgcgcc

SEQ ID NO: 961 - DNA, 28 bp, Artificial
  synthetic oligonucleotide
  modified_base (5)..(5): c or methylated C nucleotide
  modified_base (21)..(21): c or methylated C nucleotide
  modified_base (23)..(23): c or methylated C nucleotide
  modified_base (25)..(25): c or methylated C nucleotide
gagccgcattgaattaactacgcgcgcc

SEQ ID NO: 962 - DNA, 29 bp, Artificial
  synthetic oligonucleotide
  modified_base (6)..(6): c or methylated C nucleotide
  modified_base (22)..(22): c or methylated C nucleotide
  modified_base (24)..(24): c or methylated C nucleotide
  modified_base (26)..(26): c or methylated C nucleotide
agagccgcattgaattaactacgcgcgcc

SEQ ID NO: 963 - DNA, 30 bp, Artificial
  synthetic oligonucleotide
  modified_base (7)..(7): c or methylated C nucleotide
  modified_base (23)..(23): c or methylated C nucleotide
  modified_base (25)..(25): c or methylated C nucleotide
  modified_base (27)..(27): c or methylated C nucleotide
gagagccgcattgaattaactacgcgcgcc

SEQ ID NO: 964 - DNA, 31 bp, Artificial
  synthetic oligonucleotide
  modified_base (8)..(8): c or methylated C nucleotide
  modified_base (24)..(24): c or methylated C nucleotide
  modified_base (26)..(26): c or methylated C nucleotide
  modified_base (28)..(28): c or methylated C nucleotide
agagagccgcattgaattaactacgcgcgcc

SEQ ID NO: 965 - DNA, 27 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcct

SEQ ID NO: 966 - DNA, 28 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgccta

SEQ ID NO: 967 - DNA, 29 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcctac

SEQ ID NO: 968 - DNA, 30 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcctacc

SEQ ID NO: 969 - DNA, 31 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcctacca

SEQ ID NO: 970 - DNA, 28 bp, Artificial
  synthetic oligonucleotide
  modified_base (4)..(4): c or methylated C nucleotide
  modified_base (20)..(20): c or methylated C nucleotide
  modified_base (22)..(22): c or methylated C nucleotide
  modified_base (24)..(24): c or methylated C nucleotide
agccgcattgaattaactacgcgcgcct

SEQ ID NO: 971 - DNA, 30 bp, Artificial
  synthetic oligonucleotide
  modified_base (5)..(5): c or methylated C nucleotide
  modified_base (21)..(21): c or methylated C nucleotide
  modified_base (23)..(23): c or methylated C nucleotide
  modified_base (25)..(25): c or methylated C nucleotide
gagccgcattgaattaactacgcgcgccta

SEQ ID NO: 972 - DNA, 32 bp, Artificial
  synthetic oligonucleotide
  modified_base (6)..(6): c or methylated C nucleotide
  modified_base (22)..(22): c or methylated C nucleotide
  modified_base (24)..(24): c or methylated C nucleotide
  modified_base (26)..(26): c or methylated C nucleotide
agagccgcattgaattaactacgcgcgcctac

SEQ ID NO: 973 - DNA, 34 bp, Artificial
  synthetic oligonucleotide
  modified_base (7)..(7): c or methylated C nucleotide
  modified_base (23)..(23): c or methylated C nucleotide
  modified_base (25)..(25): c or methylated C nucleotide
  modified_base (27)..(27): c or methylated C nucleotide
gagagccgcattgaattaactacgcgcgcctacc

SEQ ID NO: 974 - DNA, 36 bp, Artificial
  synthetic oligonucleotide
  modified_base (8)..(8): c or methylated C nucleotide
  modified_base (24)..(24): c or methylated C nucleotide
  modified_base (26)..(26): c or methylated C nucleotide
  modified_base (28)..(28): c or methylated C nucleotide
agagagccgcattgaattaactacgcgcgcctacca

SEQ ID NO: 975 - DNA, 26 bp, Artificial
  synthetic oligonucleotide
  modified_base (6)..(6): c or methylated C nucleotide
  modified_base (22)..(22): c or methylated C nucleotide
  modified_base (24)..(24): c or methylated C nucleotide
  modified_base (26)..(26): c or methylated C nucleotide
agagccgcattgaattaactacgcgc

SEQ ID NO: 976 - DNA, 26 bp, Artificial
  synthetic oligonucleotide
  modified_base (9)..(9): c or methylated C nucleotide
  modified_base (25)..(25): c or methylated C nucleotide
aagagagccgcattgaattaactacg

SEQ ID NO: 977 - DNA, 26 bp, Artificial
  synthetic oligonucleotide
  modified_base (12)..(12): c or methylated C nucleotide
agtaagagagccgcattgaattaact

SEQ ID NO: 978 - DNA, 26 bp, Artificial
  synthetic oligonucleotide
  modified_base (15)..(15): c or methylated C nucleotide
cagagtaagagagccgcattgaatta

SEQ ID NO: 979 - DNA, 26 bp, Artificial
  synthetic oligonucleotide
  modified_base (18)..(18): c or methylated C nucleotide
aaacagagtaagagagccgcattgaa

SEQ ID NO: 980 - DNA, 26 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
gcattgaattaactacgcgcgcctac

SEQ ID NO: 981 - DNA, 26 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
ttgaattaactacgcgcgcctaccat

SEQ ID NO: 982 - DNA, 26 bp, Artificial
  synthetic oligonucleotide
  modified_base (10)..(10): c or methylated C nucleotide
  modified_base (12)..(12): c or methylated C nucleotide
  modified_base (14)..(14): c or methylated C nucleotide
aattaactacgcgcgcctaccatttt

SEQ ID NO: 983 - DNA, 26 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
taactacgcgcgcctaccattttctt

SEQ ID NO: 984 - DNA, 26 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
ctacgcgcgcctaccattttcttttg

SEQ ID NO: 985 - DNA, 24 bp, Artificial
  synthetic oligonucleotide
  modified_base (1)..(1): c or methylated C nucleotide
  modified_base (17)..(17): c or methylated C nucleotide
  modified_base (19)..(19): c or methylated C nucleotide
  modified_base (21)..(21): c or methylated C nucleotide
cgcattgaattaactacgcgcgcc

SEQ ID NO: 986 - DNA, 22 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
cattgaattaactacgcgcgcc

SEQ ID NO: 987 - DNA, 20 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
ttgaattaactacgcgcgcc

SEQ ID NO: 988 - DNA, 18 bp, Artificial
  synthetic oligonucleotide
  modified_base (11)..(11): c or methylated C nucleotide
  modified_base (13)..(13): c or methylated C nucleotide
  modified_base (15)..(15): c or methylated C nucleotide
gaattaactacgcgcgcc

SEQ ID NO: 989 - DNA, 16 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
attaactacgcgcgcc

SEQ ID NO: 990 - DNA, 15 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
ttaactacgcgcgcc

SEQ ID NO: 991 - DNA, 24 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcg

SEQ ID NO: 992 - DNA, 22 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
gccgcattgaattaactacgcg

SEQ ID NO: 993 - DNA, 20 bp, Artificial
  synthetic oligonucleotide
  modified_base (3)..(3): c or methylated C nucleotide
  modified_base (19)..(19): c or methylated C nucleotide
gccgcattgaattaactacg

SEQ ID NO: 994 - DNA, 18 bp, Artificial
  synthetic oligonucleotide
  modified_base (3)..(3): c or methylated C nucleotide
gccgcattgaattaacta

SEQ ID NO: 995 - DNA, 16 bp, Artificial
  synthetic oligonucleotide
  modified_base (3)..(3): c or methylated C nucleotide
gccgcattgaattaac

SEQ ID NO: 996 - DNA, 15 bp, Artificial
  synthetic oligonucleotide
  modified_base (3)..(3): c or methylated C nucleotide
gccgcattgaattaa

SEQ ID NO: 997 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattcactacgcgcgcc

SEQ ID NO: 998 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcatcgaattaactacgcgcgcc

SEQ ID NO: 999 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgagttaactacgcgcgcc

SEQ ID NO: 1000 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgag

SEQ ID NO: 1001 - DNA, 25 bp, Artificial
  synthetic oligonucleotide
  modified_base (4)..(4): c or methylated C nucleotide
  modified_base (11)..(11): c or methylated C nucleotide
  modified_base (22)..(22): c or methylated C nucleotide
ggccggtgggcggagagttagcgag

SEQ ID NO: 1002 - DNA, 26 bp, Artificial
  synthetic oligonucleotide
  modified_base (5)..(5): c or methylated C nucleotide
  modified_base (12)..(12): c or methylated C nucleotide
  modified_base (23)..(23): c or methylated C nucleotide
gggccggtgggcggagagttagcgag

SEQ ID NO: 1003 - DNA, 27 bp, Artificial
  synthetic oligonucleotide
  modified_base (6)..(6): c or methylated C nucleotide
  modified_base (13)..(13): c or methylated C nucleotide
  modified_base (24)..(24): c or methylated C nucleotide
agggccggtgggcggagagttagcgag

SEQ ID NO: 1004 - DNA, 28 bp, Artificial
  synthetic oligonucleotide
  modified_base (7)..(7): c or methylated C nucleotide
  modified_base (14)..(14): c or methylated C nucleotide
  modified_base (25)..(25): c or methylated C nucleotide
aagggccggtgggcggagagttagcgag

SEQ ID NO: 1005 - DNA, 29 bp, Artificial
  synthetic oligonucleotide
  modified_base (8)..(8): c or methylated C nucleotide
  modified_base (15)..(15): c or methylated C nucleotide
  modified_base (26)..(26): c or methylated C nucleotide
aaagggccggtgggcggagagttagcgag

SEQ ID NO: 1006 - DNA, 25 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgaga

SEQ ID NO: 1007 - DNA, 26 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagag

SEQ ID NO: 1008 - DNA, 27 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagaga

SEQ ID NO: 1009 - DNA, 28 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagagag

SEQ ID NO: 1010 - DNA, 29 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagagagg

SEQ ID NO: 1011 - DNA, 26 bp, Artificial
  synthetic oligonucleotide
  modified_base (4)..(4): c or methylated C nucleotide
  modified_base (11)..(11): c or methylated C nucleotide
  modified_base (22)..(22): c or methylated C nucleotide
ggccggtgggcggagagttagcgaga

SEQ ID NO: 1012 - DNA, 28 bp, Artificial
  synthetic oligonucleotide
  modified_base (5)..(5): c or methylated C nucleotide
  modified_base (12)..(12): c or methylated C nucleotide
  modified_base (23)..(23): c or methylated C nucleotide
gggccggtgggcggagagttagcgagag

SEQ ID NO: 1013 - DNA, 30 bp, Artificial
  synthetic oligonucleotide
  modified_base (6)..(6): c or methylated C nucleotide
  modified_base (13)..(13): c or methylated C nucleotide
  modified_base (24)..(24): c or methylated C nucleotide
agggccggtgggcggagagttagcgagaga

SEQ ID NO: 1014 - DNA, 32 bp, Artificial
  synthetic oligonucleotide
  modified_base (7)..(7): c or methylated C nucleotide
  modified_base (14)..(14): c or methylated C nucleotide
  modified_base (25)..(25): c or methylated C nucleotide
aagggccggtgggcggagagttagcgagagag

SEQ ID NO: 1015 - DNA, 34 bp, Artificial
  synthetic oligonucleotide
  modified_base (8)..(8): c or methylated C nucleotide
  modified_base (15)..(15): c or methylated C nucleotide
  modified_base (26)..(26): c or methylated C nucleotide
aaagggccggtgggcggagagttagcgagagagg

SEQ ID NO: 1016 - DNA, 24 bp, Artificial
  synthetic oligonucleotide
  modified_base (6)..(6): c or methylated C nucleotide
  modified_base (13)..(13): c or methylated C nucleotide
  modified_base (24)..(24): c or methylated C nucleotide
agggccggtgggcggagagttagc

SEQ ID NO: 1017 - DNA, 24 bp, Artificial
  synthetic oligonucleotide
  modified_base (9)..(9): c or methylated C nucleotide
  modified_base (16)..(16): c or methylated C nucleotide
taaagggccggtgggcggagagtt

SEQ ID NO: 1018 - DNA, 25 bp, Artificial
  synthetic oligonucleotide
  modified_base (12)..(12): c or methylated C nucleotide
  modified_base (19)..(19): c or methylated C nucleotide
ttataaagggccggtgggcggagag

SEQ ID NO: 1019 - DNA, 25 bp, Artificial
  synthetic oligonucleotide
  modified_base (15)..(15): c or methylated C nucleotide
  modified_base (22)..(22): c or methylated C nucleotide
gcattataaagggccggtgggcgga

SEQ ID NO: 1020 - DNA, 25 bp, Artificial
  synthetic oligonucleotide
  modified_base (18)..(18): c or methylated C nucleotide
  modified_base (25)..(25): c or methylated C nucleotide
ctcgcattataaagggccggtgggc

SEQ ID NO: 1021 - DNA, 24 bp, Artificial
  synthetic oligonucleotide
  modified_base (7)..(7): c or methylated C nucleotide
  modified_base (18)..(18): c or methylated C nucleotide
ggtgggcggagagttagcgagaga

SEQ ID NO: 1022 - DNA, 24 bp, Artificial
  synthetic oligonucleotide
  modified_base (4)..(4): c or methylated C nucleotide
  modified_base (15)..(15): c or methylated C nucleotide
gggcggagagttagcgagagagga

SEQ ID NO: 1023 - DNA, 24 bp, Artificial
  synthetic oligonucleotide
  modified_base (1)..(1): c or methylated C nucleotide
  modified_base (12)..(12): c or methylated C nucleotide
cggagagttagcgagagaggatct

SEQ ID NO: 1024 - DNA, 24 bp, Artificial
  synthetic oligonucleotide
  modified_base (9)..(9): c or methylated C nucleotide
agagttagcgagagaggatctttt

SEQ ID NO: 1025 - DNA, 24 bp, Artificial
  synthetic oligonucleotide
  modified_base (6)..(6): c or methylated C nucleotide
gttagcgagagaggatcttttttc

SEQ ID NO: 1026 - DNA, 22 bp, Artificial
  synthetic oligonucleotide
  modified_base (1)..(1): c or methylated C nucleotide
  modified_base (8)..(8): c or methylated C nucleotide
  modified_base (19)..(19): c or methylated C nucleotide
cggtgggcggagagttagcgag

SEQ ID NO: 1027 - DNA, 20 bp, Artificial
  synthetic oligonucleotide
  modified_base (6)..(6): c or methylated C nucleotide
  modified_base (17)..(17): c or methylated C nucleotide
gtgggcggagagttagcgag

SEQ ID NO: 1028 - DNA, 18 bp, Artificial
  synthetic oligonucleotide
  modified_base (4)..(4): c or methylated C nucleotide
  modified_base (15)..(15): c or methylated C nucleotide
gggcggagagttagcgag

SEQ ID NO: 1029 - DNA, 16 bp, Artificial
  synthetic oligonucleotide
  modified_base (2)..(2): c or methylated C nucleotide
  modified_base (13)..(13): c or methylated C nucleotide
gcggagagttagcgag

SEQ ID NO: 1030 - DNA, 14 bp, Artificial
  synthetic oligonucleotide
  modified_base (11)..(11): c or methylated C nucleotide
ggagagttagcgag

SEQ ID NO: 1031 - DNA, 22 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcg

SEQ ID NO: 1032 - DNA, 20 bp, Artificial
  synthetic oligonucleotide
  modified_base (3)..(3): c or methylated C nucleotide
  modified_base (10)..(10): c or methylated C nucleotide
gccggtgggcggagagttag

SEQ ID NO: 1033 - DNA, 18 bp, Artificial
  synthetic oligonucleotide
  modified_base (3)..(3): c or methylated C nucleotide
  modified_base (10)..(10): c or methylated C nucleotide
gccggtgggcggagagtt

SEQ ID NO: 1034 - DNA, 16 bp, Artificial
  synthetic oligonucleotide
  modified_base (3)..(3): c or methylated C nucleotide
  modified_base (10)..(10): c or methylated C nucleotide
gccggtgggcggagag

SEQ ID NO: 1035 - DNA, 15 bp, Artificial
  synthetic oligonucleotide
  modified_base (3)..(3): c or methylated C nucleotide
  modified_base (10)..(10): c or methylated C nucleotide
gccggtgggcggaga

SEQ ID NO: 1036 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggtgagttagcgag

SEQ ID NO: 1037 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtcggcggagagttagcgag

SEQ ID NO: 1038 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagctag

SEQ ID NO: 1039 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgt

SEQ ID NO: 1040 - DNA, 29 bp, Artificial
  synthetic oligonucleotide
  modified_base (4)..(4): c or methylated C nucleotide
  modified_base (6)..(6): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
  modified_base (27)..(27): c or methylated C nucleotide
ctgcgcgcccaccgccacgccacgcgcgt

SEQ ID NO: 1041 - DNA, 30 bp, Artificial
  synthetic oligonucleotide
  modified_base (5)..(5): c or methylated C nucleotide
  modified_base (7)..(7): c or methylated C nucleotide
  modified_base (14)..(14): c or methylated C nucleotide
  modified_base (19)..(19): c or methylated C nucleotide
  modified_base (24)..(24): c or methylated C nucleotide
  modified_base (26)..(26): c or methylated C nucleotide
  modified_base (28)..(28): c or methylated C nucleotide
actgcgcgcccaccgccacgccacgcgcgt

SEQ ID NO: 1042 - DNA, 31 bp, Artificial
  synthetic oligonucleotide
  modified_base (6)..(6): c or methylated C nucleotide
  modified_base (8)..(8): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
  modified_base (29)..(29): c or methylated C nucleotide
cactgcgcgcccaccgccacgccacgcgcgt

SEQ ID NO: 1043 - DNA, 32 bp, Artificial
  synthetic oligonucleotide
  modified_base (7)..(7): c or methylated C nucleotide
  modified_base (9)..(9): c or methylated C nucleotide
  modified_base (16)..(16): c or methylated C nucleotide
  modified_base (21)..(21): c or methylated C nucleotide
  modified_base (26)..(26): c or methylated C nucleotide
  modified_base (28)..(28): c or methylated C nucleotide
  modified_base (30)..(30): c or methylated C nucleotide
ccactgcgcgcccaccgccacgccacgcgcgt

SEQ ID NO: 1044 - DNA, 33 bp, Artificial
  synthetic oligonucleotide
  modified_base (8)..(8): c or methylated C nucleotide
  modified_base (10)..(10): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
  modified_base (31)..(31): c or methylated C nucleotide
accactgcgcgcccaccgccacgccacgcgcgt

SEQ ID NO: 1045 - DNA, 29 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgta

SEQ ID NO: 1046 - DNA, 30 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtac

SEQ ID NO: 1047 - DNA, 31 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtacc

SEQ ID NO: 1048 - DNA, 32 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtacca

SEQ ID NO: 1049 - DNA, 33 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtaccag

SEQ ID NO: 1050 - DNA, 30 bp, Artificial
  synthetic oligonucleotide
  modified_base (4)..(4): c or methylated C nucleotide
  modified_base (6)..(6): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
  modified_base (27)..(27): c or methylated C nucleotide
ctgcgcgcccaccgccacgccacgcgcgta

SEQ ID NO: 1051 - DNA, 32 bp, Artificial
  synthetic oligonucleotide
  modified_base (5)..(5): c or methylated C nucleotide
  modified_base (7)..(7): c or methylated C nucleotide
  modified_base (14)..(14): c or methylated C nucleotide
  modified_base (19)..(19): c or methylated C nucleotide
  modified_base (24)..(24): c or methylated C nucleotide
  modified_base (26)..(26): c or methylated C nucleotide
  modified_base (28)..(28): c or methylated C nucleotide
actgcgcgcccaccgccacgccacgcgcgtac

SEQ ID NO: 1052 - DNA, 34 bp, Artificial
  synthetic oligonucleotide
  modified_base (6)..(6): c or methylated C nucleotide
  modified_base (8)..(8): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
  modified_base (29)..(29): c or methylated C nucleotide
cactgcgcgcccaccgccacgccacgcgcgtacc

SEQ ID NO: 1053 - DNA, 36 bp, Artificial
  synthetic oligonucleotide
  modified_base (7)..(7): c or methylated C nucleotide
  modified_base (9)..(9): c or methylated C nucleotide
  modified_base (16)..(16): c or methylated C nucleotide
  modified_base (21)..(21): c or methylated C nucleotide
  modified_base (26)..(26): c or methylated C nucleotide
  modified_base (28)..(28): c or methylated C nucleotide
  modified_base (30)..(30): c or methylated C nucleotide
ccactgcgcgcccaccgccacgccacgcgcgtacca

SEQ ID NO: 1054 - DNA, 38 bp, Artificial
  synthetic oligonucleotide
  modified_base (8)..(8): c or methylated C nucleotide
  modified_base (10)..(10): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
  modified_base (31)..(31): c or methylated C nucleotide
accactgcgcgcccaccgccacgccacgcgcgtaccag

SEQ ID NO: 1055 - DNA, 28 bp, Artificial
  synthetic oligonucleotide
  modified_base (6)..(6): c or methylated C nucleotide
  modified_base (8)..(8): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
cactgcgcgcccaccgccacgccacgcg

SEQ ID NO: 1056 - DNA, 28 bp, Artificial
  synthetic oligonucleotide
  modified_base (9)..(9): c or methylated C nucleotide
  modified_base (11)..(11): c or methylated C nucleotide
  modified_base (18)..(18): c or methylated C nucleotide
  modified_base (23)..(23): c or methylated C nucleotide
  modified_base (28)..(28): c or methylated C nucleotide
aaccactgcgcgcccaccgccacgccac

SEQ ID NO: 1057 - DNA, 28 bp, Artificial
  synthetic oligonucleotide
  modified_base (12)..(12): c or methylated C nucleotide
  modified_base (14)..(14): c or methylated C nucleotide
  modified_base (21)..(21): c or methylated C nucleotide
  modified_base (26)..(26): c or methylated C nucleotide
gagaaccactgcgcgcccaccgccacgc

SEQ ID NO: 1058 - DNA, 28 bp, Artificial
  synthetic oligonucleotide
  modified_base (15)..(15): c or methylated C nucleotide
  modified_base (17)..(17): c or methylated C nucleotide
  modified_base (24)..(24): c or methylated C nucleotide
accgagaaccactgcgcgcccaccgcca

SEQ ID NO: 1059 - DNA, 28 bp, Artificial
  synthetic oligonucleotide
  modified_base (18)..(18): c or methylated C nucleotide
  modified_base (20)..(20): c or methylated C nucleotide
  modified_base (27)..(27): c or methylated C nucleotide
cacaccgagaaccactgcgcgcccaccg

SEQ ID NO: 1060 - DNA, 28 bp, Artificial
  synthetic oligonucleotide
  modified_base (2)..(2): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
  modified_base (23)..(23): c or methylated C nucleotide
gcgcccaccgccacgccacgcgcgtacc

SEQ ID NO: 1061 - DNA, 28 bp, Artificial
  synthetic oligonucleotide
  modified_base (6)..(6): c or methylated C nucleotide
  modified_base (11)..(11): c or methylated C nucleotide
  modified_base (16)..(16): c or methylated C nucleotide
  modified_base (18)..(18): c or methylated C nucleotide
  modified_base (20)..(20): c or methylated C nucleotide
cccaccgccacgccacgcgcgtaccagg

SEQ ID NO: 1062 - DNA, 28 bp, Artificial
  synthetic oligonucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
  modified_base (17)..(17): c or methylated C nucleotide
accgccacgccacgcgcgtaccaggctg

SEQ ID NO: 1063 - DNA, 28 bp, Artificial
  synthetic oligonucleotide
  modified_base (5)..(5): c or methylated C nucleotide
  modified_base (10)..(10): c or methylated C nucleotide
  modified_base (12)..(12): c or methylated C nucleotide
  modified_base (14)..(14): c or methylated C nucleotide
gccacgccacgcgcgtaccaggctgcag

SEQ ID NO: 1064 - DNA, 26 bp, Artificial
  synthetic oligonucleotide
  modified_base (1)..(1): c or methylated C nucleotide
  modified_base (3)..(3): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
  modified_base (24)..(24): c or methylated C nucleotide
cgcgcccaccgccacgccacgcgcgt

SEQ ID NO: 1065 - DNA, 24 bp, Artificial
  synthetic oligonucleotide
  modified_base (1)..(1): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
  modified_base (22)..(22): c or methylated C nucleotide
cgcccaccgccacgccacgcgcgt

SEQ ID NO: 1066 - DNA, 22 bp, Artificial
  synthetic oligonucleotide
  modified_base (6)..(6): c or methylated C nucleotide
  modified_base (11)..(11): c or methylated C nucleotide
  modified_base (16)..(16): c or methylated C nucleotide
  modified_base (18)..(18): c or methylated C nucleotide
  modified_base (20)..(20): c or methylated C nucleotide
cccaccgccacgccacgcgcgt

SEQ ID NO: 1067 - DNA, 20 bp, Artificial
  synthetic oligonucleotide
  modified_base (4)..(4): c or methylated C nucleotide
  modified_base (9)..(9): c or methylated C nucleotide
  modified_base (14)..(14): c or methylated C nucleotide
  modified_base (16)..(16): c or methylated C nucleotide
  modified_base (18)..(18): c or methylated C nucleotide
caccgccacgccacgcgcgt

SEQ ID NO: 1068 - DNA, 18 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (14)..(14): c or methylated C nucleotide
  modified_base (16)..(16): c or methylated C nucleotide
ccgccacgccacgcgcgt

SEQ ID NO: 1069 - DNA, 16 bp, Artificial
  synthetic oligonucleotide
  modified_base (5)..(5): c or methylated C nucleotide
  modified_base (10)..(10): c or methylated C nucleotide
  modified_base (12)..(12): c or methylated C nucleotide
  modified_base (14)..(14): c or methylated C nucleotide
gccacgccacgcgcgt

SEQ ID NO: 1070 - DNA, 15 bp, Artificial
  synthetic oligonucleotide
  modified_base (4)..(4): c or methylated C nucleotide
  modified_base (9)..(9): c or methylated C nucleotide
  modified_base (11)..(11): c or methylated C nucleotide
  modified_base (13)..(13): c or methylated C nucleotide
ccacgccacgcgcgt

SEQ ID NO: 1071 - DNA, 26 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgc

SEQ ID NO: 1072 - DNA, 24 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
tgcgcgcccaccgccacgccacgc

SEQ ID NO: 1073 - DNA, 22 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
tgcgcgcccaccgccacgccac

SEQ ID NO: 1074 - DNA, 20 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
tgcgcgcccaccgccacgcc

SEQ ID NO: 1075 - DNA, 18 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
tgcgcgcccaccgccacg

SEQ ID NO: 1076 - DNA, 16 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
tgcgcgcccaccgcca

SEQ ID NO: 1077 - DNA, 15 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
tgcgcgcccaccgcc

SEQ ID NO: 1078 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccgcgccacgcgcgt

SEQ ID NO: 1079 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgtccaccgccacgccacgcgcgt

SEQ ID NO: 1080 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccgccgccacgccacgcgcgt

SEQ ID NO: 1081 - DNA, 1300 bp, Homo sapiens
gagctccgggtacctggagaacatgaatctcccgggtgtactgtccccatgagggtcaccgaggaacctatggatcttccactcttcgcccagaatgtcttccctctatcccctccacctccccaaattccagcaccaggggccacctcagagccacaaatcctgaaaggaccacccaggtgactcgggcccacacacccctctttcggggtacacttggtggcaggctagcaggcttttggcctcagctggtggtgccatataaccagattcgtcacagagacccattttttatcagtcccaggccagaagtacgaagactgatcttaacgatgtggcctgcctgggaggtaaggcggcaggcgttgccagaattgatgggaactgtggcacaggtgggaaacctggtttaacaaattcttcattgattcaggggaccactttccttgagccaagtcttggcaagcggccggcgaaactcacaggtccctttcctggctgcgtccccagcctccagccttccccgccccagagatgccccaggagcggcccctcggtgtaggtaacgggtgcccgggcggctccgctccgccgcctagagcctggaagccgccactgcggcccaggacaatccggctacgcggccggcgccgaccccgcacgctggagtccgctgccgcacggcgctggcagtcgggggtggtgtctgaagtcaggcgcttcctgccttttcgtcggcccgggtgcccggctcgcgccgccaggctctgggatcccaggtcgccccgcccagcagcccgcgccctgctcggtgcgctcagcgtccccgccccttaccccaaacccccaccctctgtgccctcaggggggcacccccatcggggcgggaggggggggtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtacgtacgccggctgcggcgccccctgcgccgcgcgacaccctgcttcccccggtccccgccgagttcccctttccgggggtttctgcgcccgcctgggagagtggagagaagcg

SEQ ID NO: 1082 - DNA, 30 bp, Artificial
  synthetic oligonucleotide
  modified_base (2)..(2): c or methylated C nucleotide
  modified_base (5)..(5): c or methylated C nucleotide
  modified_base (7)..(7): c or methylated C nucleotide
  modified_base (15)..(15): c or methylated C nucleotide
  modified_base (27)..(27): c or methylated C nucleotide
ccggcgcgggagggcggagggaggaccgta

SEQ ID NO: 1083 - DNA, 27 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (19)..(19): c or methylated C nucleotide
  modified_base (22)..(22): c or methylated C nucleotide
  modified_base (25)..(25): c or methylated C nucleotide
tcgccccgcagcgctgcccgccggcgg

SEQ ID NO: 1084 - DNA, 27 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (25)..(25): c or methylated C nucleotide
aggggcggggacgctgagcggcaccga

SEQ ID NO: 1085 - DNA, 25 bp, Artificial
  synthetic oligonucleotide
  modified_base (5)..(5): c or methylated C nucleotide
  modified_base (7)..(7): c or methylated C nucleotide
  modified_base (19)..(19): c or methylated C nucleotide
  modified_base (23)..(23): c or methylated C nucleotide
agggcgcgggctgctgggcgggcga

SEQ ID NO: 1086 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacga

SEQ ID NO: 1087 - DNA, 28 bp, Artificial
  synthetic oligonucleotide
  modified_base (3)..(3): c or methylated C nucleotide
  modified_base (7)..(7): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (23)..(23): c or methylated C nucleotide
  modified_base (25)..(25): c or methylated C nucleotide
agcgtgcggggtcggcgccggccgcgta

SEQ ID NO: 1088 - DNA, 29 bp, Artificial
  synthetic oligonucleotide
  modified_base (2)..(2): c or methylated C nucleotide
  modified_base (5)..(5): c or methylated C nucleotide
  modified_base (9)..(9): c or methylated C nucleotide
  modified_base (15)..(15): c or methylated C nucleotide
  modified_base (19)..(19): c or methylated C nucleotide
  modified_base (27)..(27): c or methylated C nucleotide
gcggcggacggagccgcccgggcacccgt

SEQ ID NO: 1089 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcgg

SEQ ID NO: 1090 - DNA, 26 bp, Artificial
  synthetic oligonucleotide
  modified_base (3)..(3): c or methylated C nucleotide
  modified_base (25)..(25): c or methylated C nucleotide
gccgctcctggggcatctctggggcg

SEQ ID NO: 1091 - DNA, 31 bp, Artificial
  synthetic oligonucleotide
  modified_base (2)..(2): c or methylated C nucleotide
  modified_base (9)..(9): c or methylated C nucleotide
  modified_base (16)..(16): c or methylated C nucleotide
  modified_base (21)..(21): c or methylated C nucleotide
  modified_base (24)..(24): c or methylated C nucleotide
  modified_base (27)..(27): c or methylated C nucleotide
  modified_base (29)..(29): c or methylated C nucleotide
gcggtgcccgagtggcggagcggcgccgcgg

SEQ ID NO: 1092 - DNA, 27 bp, Artificial
  synthetic oligonucleotide
  modified_base (2)..(2): c or methylated C nucleotide
  modified_base (6)..(6): c or methylated C nucleotide
  modified_base (10)..(10): c or methylated C nucleotide
acgggcgggcgggcagcaggctctcca

SEQ ID NO: 1093 - DNA, 30 bp, Artificial
  synthetic oligonucleotide
  modified_base (2)..(2): c or methylated C nucleotide
  modified_base (28)..(28): c or methylated C nucleotide
ccgccttacctcccaggcaggccacatcgt

SEQ ID NO: 1094 - DNA, 25 bp, Artificial
  synthetic oligonucleotide
  modified_base (2)..(2): c or methylated C nucleotide
  modified_base (23)..(23): c or methylated C nucleotide
ccgaaagaggggtgtgtgggcccga

SEQ ID NO: 1095 - DNA, 25 bp, Artificial
  synthetic oligonucleotide
catgttctccaggtacccggagctc

SEQ ID NO: 1096 - DNA, 31 bp, Artificial
  synthetic oligonucleotide
cggtgaccctcatggggacagtacacccggg

SEQ ID NO: 1097 - DNA, 30 bp, Artificial
  synthetic oligonucleotide
gatagagggaagacattctgggcgaagagt

SEQ ID NO: 1098 - DNA, 28 bp, Artificial
  synthetic oligonucleotide
gtgagtttcgccggccgcttgccaagac

SEQ ID NO: 1099 - DNA, 27 bp, Artificial
  synthetic oligonucleotide
ccgcgtagccggattgtcctgggccgc

SEQ ID NO: 1100 - DNA, 21 bp, Artificial
  synthetic oligonucleotide
cgccgtgcggcagcggactcc

SEQ ID NO: 1101 - DNA, 26 bp, Artificial
  synthetic oligonucleotide
gcgcctgacttcagacaccacccccg

SEQ ID NO: 1102 - DNA, 37 bp, Artificial
  synthetic oligonucleotide
gcgaccggggcacagctgacccccccctcccgccccg

SEQ ID NO: 1103 - DNA, 28 bp, Artificial
  synthetic oligonucleotide
gcggctaccgtcacctcctcgccactcg

SEQ ID NO: 1104 - DNA, 25 bp, Artificial
  synthetic oligonucleotide
gcgaacagggcgagctgtccagccg

SEQ ID NO: 1105 - DNA, 25 bp, Artificial
  synthetic oligonucleotide
gccacgggcgggtctgcactcagcg

SEQ ID NO: 1106 - DNA, 28 bp, Artificial
  synthetic oligonucleotide
gggtctctgtgacgaatctggtgtgtgg

SEQ ID NO: 1107 - DNA, 24 bp, Artificial
  synthetic oligonucleotide
cagttcccatcaattctgcaacgc

SEQ ID NO: 1108 - DNA, 25 bp, Artificial
  synthetic oligonucleotide
gcgggggaaaaagacgcagactagg

SEQ ID NO: 1109 - DNA, 31 bp, Artificial
  synthetic oligonucleotide
gacgtgctgttctccaaggcctggcacgcag

SEQ ID NO: 1110 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccga

SEQ ID NO: 1111 - DNA, 27 bp, Artificial
  synthetic oligonucleotide
  modified_base (7)..(7): c or methylated C nucleotide
  modified_base (13)..(13): c or methylated C nucleotide
  modified_base (20)..(20): c or methylated C nucleotide
  modified_base (25)..(25): c or methylated C nucleotide
aaggggcggggacgctgagcgcaccga

SEQ ID NO: 1112 - DNA, 28 bp, Artificial
  synthetic oligonucleotide
  modified_base (8)..(8): c or methylated C nucleotide
  modified_base (14)..(14): c or methylated C nucleotide
  modified_base (21)..(21): c or methylated C nucleotide
  modified_base (26)..(26): c or methylated C nucleotide
taaggggcggggacgctgagcgcaccga

SEQ ID NO: 1113 - DNA, 29 bp, Artificial
  synthetic oligonucleotide
  modified_base (9)..(9): c or methylated C nucleotide
  modified_base (15)..(15): c or methylated C nucleotide
  modified_base (22)..(22): c or methylated C nucleotide
  modified_base (27)..(27): c or methylated C nucleotide
gtaaggggcggggacgctgagcgcaccga

SEQ ID NO: 1114 - DNA, 30 bp, Artificial
  synthetic oligonucleotide
  modified_base (10)..(10): c or methylated C nucleotide
  modified_base (16)..(16): c or methylated C nucleotide
  modified_base (23)..(23): c or methylated C nucleotide
  modified_base (28)..(28): c or methylated C nucleotide
ggtaaggggcggggacgctgagcgcaccga

SEQ ID NO: 1115 - DNA, 31 bp, Artificial
  synthetic oligonucleotide
  modified_base (11)..(11): c or methylated C nucleotide
  modified_base (17)..(17): c or methylated C nucleotide
  modified_base (24)..(24): c or methylated C nucleotide
  modified_base (29)..(29): c or methylated C nucleotide
gggtaaggggcggggacgctgagcgcaccga

SEQ ID NO: 1116 - DNA, 27 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgag

SEQ ID NO: 1117 - DNA, 28 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagc

SEQ ID NO: 1118 - DNA, 29 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagca

SEQ ID NO: 1119 - DNA, 30 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagcag

SEQ ID NO: 1120 - DNA, 31 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagcagg

SEQ ID NO: 1121 - DNA, 28 bp, Artificial
  synthetic oligonucleotide
  modified_base (7)..(7): c or methylated C nucleotide
  modified_base (13)..(13): c or methylated C nucleotide
  modified_base (20)..(20): c or methylated C nucleotide
  modified_base (25)..(25): c or methylated C nucleotide
aaggggcggggacgctgagcgcaccgag

SEQ ID NO: 1122 - DNA, 30 bp, Artificial
  synthetic oligonucleotide
  modified_base (8)..(8): c or methylated C nucleotide
  modified_base (14)..(14): c or methylated C nucleotide
  modified_base (21)..(21): c or methylated C nucleotide
  modified_base (26)..(26): c or methylated C nucleotide
taaggggcggggacgctgagcgcaccgagc

SEQ ID NO: 1123 - DNA, 32 bp, Artificial
  synthetic oligonucleotide
  modified_base (9)..(9): c or methylated C nucleotide
  modified_base (15)..(15): c or methylated C nucleotide
  modified_base (22)..(22): c or methylated C nucleotide
  modified_base (27)..(27): c or methylated C nucleotide
gtaaggggcggggacgctgagcgcaccgagca

SEQ ID NO: 1124 - DNA, 34 bp, Artificial
  synthetic oligonucleotide
  modified_base (10)..(10): c or methylated C nucleotide
  modified_base (16)..(16): c or methylated C nucleotide
  modified_base (23)..(23): c or methylated C nucleotide
  modified_base (28)..(28): c or methylated C nucleotide
ggtaaggggcggggacgctgagcgcaccgagcag

SEQ ID NO: 1125 - DNA, 36 bp, Artificial
  synthetic oligonucleotide
  modified_base (11)..(11): c or methylated C nucleotide
  modified_base (17)..(17): c or methylated C nucleotide
  modified_base (24)..(24): c or methylated C nucleotide
  modified_base (29)..(29): c or methylated C nucleotide
gggtaaggggcggggacgctgagcgcaccgagcagg

SEQ ID NO: 1126 - DNA, 26 bp, Artificial
  synthetic oligonucleotide
  modified_base (9)..(9): c or methylated C nucleotide
  modified_base (15)..(15): c or methylated C nucleotide
  modified_base (22)..(22): c or methylated C nucleotide
gtaaggggcggggacgctgagcgcac

SEQ ID NO: 1127 - DNA, 26 bp, Artificial
  synthetic oligonucleotide
  modified_base (12)..(12): c or methylated C nucleotide
  modified_base (18)..(18): c or methylated C nucleotide
  modified_base (25)..(25): c or methylated C nucleotide
ggggtaaggggcggggacgctgagcg

SEQ ID NO: 1128 - DNA, 27 bp, Artificial
  synthetic oligonucleotide
  modified_base (15)..(15): c or methylated C nucleotide
  modified_base (21)..(21): c or methylated C nucleotide
tttggggtaaggggcggggacgctgag

SEQ ID NO: 1129 - DNA, 27 bp, Artificial
  synthetic oligonucleotide
  modified_base (18)..(18): c or methylated C nucleotide
  modified_base (24)..(24): c or methylated C nucleotide
gggtttggggtaaggggcggggacgct

SEQ ID NO: 1130 - DNA, 27 bp, Artificial
  synthetic oligonucleotide
  modified_base (21)..(21): c or methylated C nucleotide
  modified_base (27)..(27): c or methylated C nucleotide
tgggggtttggggtaaggggcggggac

SEQ ID NO: 1131 - DNA, 26 bp, Artificial
  synthetic oligonucleotide
  modified_base (3)..(3): c or methylated C nucleotide
  modified_base (9)..(9): c or methylated C nucleotide
  modified_base (16)..(16): c or methylated C nucleotide
  modified_base (21)..(21): c or methylated C nucleotide
ggcggggacgctgagcgcaccgagca

SEQ ID NO: 1132 - DNA, 26 bp, Artificial
  synthetic oligonucleotide
  modified_base (6)..(6): c or methylated C nucleotide
  modified_base (13)..(13): c or methylated C nucleotide
  modified_base (18)..(18): c or methylated C nucleotide
ggggacgctgagcgcaccgagcaggg

SEQ ID NO: 1133 - DNA, 26 bp, Artificial
  synthetic oligonucleotide
  modified_base (3)..(3): c or methylated C nucleotide
  modified_base (10)..(10): c or methylated C nucleotide
  modified_base (15)..(15): c or methylated C nucleotide
gacgctgagcgcaccgagcagggcgc

SEQ ID NO: 1134 - DNA, 26 bp, Artificial
  synthetic oligonucleotide
  modified_base (7)..(7): c or methylated C nucleotide
  modified_base (12)..(12): c or methylated C nucleotide
gctgagcgcaccgagcagggcgcggg

SEQ ID NO: 1135 - DNA, 26 bp, Artificial
  synthetic oligonucleotide
  modified_base (4)..(4): c or methylated C nucleotide
  modified_base (9)..(9): c or methylated C nucleotide
gagcgcaccgagcagggcgcgggctg

SEQ ID NO: 1136 - DNA, 24 bp, Artificial
  synthetic oligonucleotide
  modified_base (4)..(4): c or methylated C nucleotide
  modified_base (10)..(10): c or methylated C nucleotide
  modified_base (17)..(17): c or methylated C nucleotide
  modified_base (22)..(22): c or methylated C nucleotide
gggcggggacgctgagcgcaccga

SEQ ID NO: 1137 - DNA, 22 bp, Artificial
  synthetic oligonucleotide
  modified_base (2)..(2): c or methylated C nucleotide
  modified_base (8)..(8): c or methylated C nucleotide
  modified_base (15)..(15): c or methylated C nucleotide
  modified_base (20)..(20): c or methylated C nucleotide
gcggggacgctgagcgcaccga

SEQ ID NO: 1138 - DNA, 20 bp, Artificial
  synthetic oligonucleotide
  modified_base (6)..(6): c or methylated C nucleotide
  modified_base (13)..(13): c or methylated C nucleotide
  modified_base (18)..(18): c or methylated C nucleotide
ggggacgctgagcgcaccga

SEQ ID NO: 1139 - DNA, 18 bp, Artificial
  synthetic oligonucleotide
  modified_base (4)..(4): c or methylated C nucleotide
  modified_base (11)..(11): c or methylated C nucleotide
  modified_base (16)..(16): c or methylated C nucleotide
ggacgctgagcgcaccga

SEQ ID NO: 1140 - DNA, 16 bp, Artificial
  synthetic oligonucleotide
  modified_base (2)..(2): c or methylated C nucleotide
  modified_base (9)..(9): c or methylated C nucleotide
  modified_base (14)..(14): c or methylated C nucleotide
acgctgagcgcaccga

SEQ ID NO: 1141 - DNA, 14 bp, Artificial
  synthetic oligonucleotide
  modified_base (7)..(7): c or methylated C nucleotide
  modified_base (12)..(12): c or methylated C nucleotide
gctgagcgcaccga

SEQ ID NO: 1142 - DNA, 24 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcacc

SEQ ID NO: 1143 - DNA, 22 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
aggggcggggacgctgagcgca

SEQ ID NO: 1144 - DNA, 20 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
aggggcggggacgctgagcg

SEQ ID NO: 1145 - DNA, 19 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
aggggcggggacgctgagc

SEQ ID NO: 1146 - DNA, 17 bp, Artificial
  synthetic oligonucleotide
  modified_base (6)..(6): c or methylated C nucleotide
  modified_base (12)..(12): c or methylated C nucleotide
aggggcggggacgctga

SEQ ID NO: 1147 - DNA, 15 bp, Artificial
  synthetic oligonucleotide
  modified_base (6)..(6): c or methylated C nucleotide
  modified_base (12)..(12): c or methylated C nucleotide
aggggcggggacgct

SEQ ID NO: 1148 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcgaggacgctgagcgcaccga

SEQ ID NO: 1149 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgatcgcaccga

SEQ ID NO: 1150 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctcagcgcaccga

SEQ ID NO: 1151 - DNA, 35 bp, Artificial; identical to SEQ ID NO: 1086
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide

SEQ ID NO: 1152 - DNA, 36 bp, Artificial
  synthetic oligonucleotide
  modified_base (8)..(8): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (26)..(26): c or methylated C nucleotide
  modified_base (31)..(31): c or methylated C nucleotide
  modified_base (34)..(34): c or methylated C nucleotide
agcctggcggcgcgagccgggcacccgggccgacga

SEQ ID NO: 1153 - DNA, 37 bp, Artificial
  synthetic oligonucleotide
  modified_base (9)..(9): c or methylated C nucleotide
  modified_base (12)..(12): c or methylated C nucleotide
  modified_base (14)..(14): c or methylated C nucleotide
  modified_base (19)..(19): c or methylated C nucleotide
  modified_base (27)..(27): c or methylated C nucleotide
  modified_base (32)..(32): c or methylated C nucleotide
  modified_base (35)..(35): c or methylated C nucleotide
gagcctggcggcgcgagccgggcacccgggccgacga

SEQ ID NO: 1154 - DNA, 38 bp, Artificial
  synthetic oligonucleotide
  modified_base (10)..(10): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (28)..(28): c or methylated C nucleotide
  modified_base (33)..(33): c or methylated C nucleotide
  modified_base (36)..(36): c or methylated C nucleotide
agagcctggcggcgcgagccgggcacccgggccgacga

SEQ ID NO: 1155 - DNA, 39 bp, Artificial
  synthetic oligonucleotide
  modified_base (11)..(11): c or methylated C nucleotide
  modified_base (14)..(14): c or methylated C nucleotide
  modified_base (16)..(16): c or methylated C nucleotide
  modified_base (21)..(21): c or methylated C nucleotide
  modified_base (29)..(29): c or methylated C nucleotide
  modified_base (34)..(34): c or methylated C nucleotide
  modified_base (37)..(37): c or methylated C nucleotide
cagagcctggcggcgcgagccgggcacccgggccgacga

SEQ ID NO: 1156 - DNA, 40 bp, Artificial
  synthetic oligonucleotide
  modified_base (12)..(12): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (30)..(30): c or methylated C nucleotide
  modified_base (35)..(35): c or methylated C nucleotide
  modified_base (38)..(38): c or methylated C nucleotide
ccagagcctggcggcgcgagccgggcacccgggccgacga

SEQ ID NO: 1157 - DNA, 36 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaa

SEQ ID NO: 1158 - DNA, 37 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaa

SEQ ID NO: 1159 - DNA, 38 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaaa

SEQ ID NO: 1160 - DNA, 39 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaaag

SEQ ID NO: 1161 - DNA, 40 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaaagg

SEQ ID NO: 1162 - DNA, 37 bp, Artificial
  synthetic oligonucleotide
  modified_base (8)..(8): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (26)..(26): c or methylated C nucleotide
  modified_base (31)..(31): c or methylated C nucleotide
  modified_base (34)..(34): c or methylated C nucleotide
agcctggcggcgcgagccgggcacccgggccgacgaa

SEQ ID NO: 1163 - DNA, 39 bp, Artificial
  synthetic oligonucleotide
  modified_base (9)..(9): c or methylated C nucleotide
  modified_base (12)..(12): c or methylated C nucleotide
  modified_base (14)..(14): c or methylated C nucleotide
  modified_base (19)..(19): c or methylated C nucleotide
  modified_base (27)..(27): c or methylated C nucleotide
  modified_base (32)..(32): c or methylated C nucleotide
  modified_base (35)..(35): c or methylated C nucleotide
gagcctggcggcgcgagccgggcacccgggccgacgaaa

SEQ ID NO: 1164 - DNA, 41 bp, Artificial
  synthetic oligonucleotide
  modified_base (10)..(10): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (28)..(28): c or methylated C nucleotide
  modified_base (33)..(33): c or methylated C nucleotide
  modified_base (36)..(36): c or methylated C nucleotide
agagcctggcggcgcgagccgggcacccgggccgacgaaaa

SEQ ID NO: 1165 - DNA, 43 bp, Artificial
  synthetic oligonucleotide
  modified_base (11)..(11): c or methylated C nucleotide
  modified_base (14)..(14): c or methylated C nucleotide
  modified_base (16)..(16): c or methylated C nucleotide
  modified_base (21)..(21): c or methylated C nucleotide
  modified_base (29)..(29): c or methylated C nucleotide
  modified_base (34)..(34): c or methylated C nucleotide
  modified_base (37)..(37): c or methylated C nucleotide
cagagcctggcggcgcgagccgggcacccgggccgacgaaaag

SEQ ID NO: 1166 - DNA, 45 bp, Artificial
  synthetic oligonucleotide
  modified_base (12)..(12): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (30)..(30): c or methylated C nucleotide
  modified_base (35)..(35): c or methylated C nucleotide
  modified_base (38)..(38): c or methylated C nucleotide
ccagagcctggcggcgcgagccgggcacccgggccgacgaaaagg

SEQ ID NO: 1167 - DNA, 35 bp, Artificial
  synthetic oligonucleotide
  modified_base (10)..(10): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (28)..(28): c or methylated C nucleotide
  modified_base (33)..(33): c or methylated C nucleotide
agagcctggcggcgcgagccgggcacccgggccga

SEQ ID NO: 1168 - DNA, 35 bp, Artificial
  synthetic oligonucleotide
  modified_base (13)..(13): c or methylated C nucleotide
  modified_base (16)..(16): c or methylated C nucleotide
  modified_base (18)..(18): c or methylated C nucleotide
  modified_base (23)..(23): c or methylated C nucleotide
  modified_base (31)..(31): c or methylated C nucleotide
cccagagcctggcggcgcgagccgggcacccgggc

SEQ ID NO: 1169 - DNA, 35 bp, Artificial
  synthetic oligonucleotide
  modified_base (16)..(16): c or methylated C nucleotide
  modified_base (19)..(19): c or methylated C nucleotide
  modified_base (21)..(21): c or methylated C nucleotide
  modified_base (26)..(26): c or methylated C nucleotide
  modified_base (34)..(34): c or methylated C nucleotide
gatcccagagcctggcggcgcgagccgggcacccg

SEQ ID NO: 1170 - DNA, 35 bp, Artificial
  synthetic oligonucleotide
  modified_base (19)..(19): c or methylated C nucleotide
  modified_base (22)..(22): c or methylated C nucleotide
  modified_base (24)..(24): c or methylated C nucleotide
  modified_base (29)..(29): c or methylated C nucleotide
tgggatcccagagcctggcggcgcgagccgggcac

SEQ ID NO: 1171 - DNA, 35 bp, Artificial
  synthetic oligonucleotide
  modified_base (22)..(22): c or methylated C nucleotide
  modified_base (25)..(25): c or methylated C nucleotide
  modified_base (27)..(27): c or methylated C nucleotide
  modified_base (32)..(32): c or methylated C nucleotide
acctgggatcccagagcctggcggcgcgagccggg

SEQ ID NO: 1172 - DNA, 35 bp, Artificial
  synthetic oligonucleotide
  modified_base (4)..(4): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (22)..(22): c or methylated C nucleotide
  modified_base (27)..(27): c or methylated C nucleotide
  modified_base (30)..(30): c or methylated C nucleotide
tggcggcgcgagccgggcacccgggccgacgaaaa

SEQ ID NO: 1173 - DNA, 35 bp, Artificial
  synthetic oligonucleotide
  modified_base (1)..(1): c or methylated C nucleotide
  modified_base (4)..(4): c or methylated C nucleotide
  modified_base (6)..(6): c or methylated C nucleotide
  modified_base (11)..(11): c or methylated C nucleotide
  modified_base (19)..(19): c or methylated C nucleotide
  modified_base (24)..(24): c or methylated C nucleotide
  modified_base (27)..(27): c or methylated C nucleotide
cggcgcgagccgggcacccgggccgacgaaaaggc

SEQ ID NO: 1174 - DNA, 35 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (16)..(16): c or methylated C nucleotide
  modified_base (21)..(21): c or methylated C nucleotide
  modified_base (24)..(24): c or methylated C nucleotide
cgcgagccgggcacccgggccgacgaaaaggcagg

SEQ ID NO: 1175 - DNA, 35 bp, Artificial
  synthetic oligonucleotide
  modified_base (5)..(5): c or methylated C nucleotide
  modified_base (13)..(13): c or methylated C nucleotide
  modified_base (18)..(18): c or methylated C nucleotide
  modified_base (21)..(21): c or methylated C nucleotide
gagccgggcacccgggccgacgaaaaggcaggaag

SEQ ID NO: 1176 - DNA, 35 bp, Artificial
  synthetic oligonucleotide
  modified_base (2)..(2): c or methylated C nucleotide
  modified_base (10)..(10): c or methylated C nucleotide
  modified_base (15)..(15): c or methylated C nucleotide
  modified_base (18)..(18): c or methylated C nucleotide
ccgggcacccgggccgacgaaaaggcaggaagcgc

SEQ ID NO: 1177 - DNA, 33 bp, Artificial
  synthetic oligonucleotide
  modified_base (5)..(5): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (23)..(23): c or methylated C nucleotide
  modified_base (28)..(28): c or methylated C nucleotide
  modified_base (31)..(31): c or methylated C nucleotide
ctggcggcgcgagccgggcacccgggccgacga

SEQ ID NO: 1178 - DNA, 31 bp, Artificial
  synthetic oligonucleotide
  modified_base (3)..(3): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (21)..(21): c or methylated C nucleotide
  modified_base (26)..(26): c or methylated C nucleotide
  modified_base (29)..(29): c or methylated C nucleotide
ggcggcgcgagccgggcacccgggccgacga

SEQ ID NO: 1179 - DNA, 29 bp, Artificial
  synthetic oligonucleotide
  modified_base (1)..(1): c or methylated C nucleotide
  modified_base (4)..(4): c or methylated C nucleotide
  modified_base (6)..(6): c or methylated C nucleotide
  modified_base (11)..(11): c or methylated C nucleotide
  modified_base (19)..(19): c or methylated C nucleotide
  modified_base (24)..(24): c or methylated C nucleotide
  modified_base (27)..(27): c or methylated C nucleotide
cggcgcgagccgggcacccgggccgacga

SEQ ID NO: 1180 - DNA, 27 bp, Artificial
  synthetic oligonucleotide
  modified_base (2)..(2): c or methylated C nucleotide
  modified_base (4)..(4): c or methylated C nucleotide
  modified_base (9)..(9): c or methylated C nucleotide
  modified_base (17)..(17): c or methylated C nucleotide
  modified_base (22)..(22): c or methylated C nucleotide
  modified_base (25)..(25): c or methylated C nucleotide
gcgcgagccgggcacccgggccgacga

SEQ ID NO: 1181 - DNA, 25 bp, Artificial
  synthetic oligonucleotide
  modified_base (2)..(2)
  modified_base (2)..(2): c or methylated C nucleotide
  modified_base (7)..(7)
  modified_base (15)..(15)
  modified_base (20)..(20)
  modified_base (23)..(23)
gcgagccgggcacccgggccgacga

SEQ ID NO: 1182 - DNA, 23 bp, Artificial
  synthetic oligonucleotide
  modified_base (5)..(5): c or methylated C nucleotide
  modified_base (13)..(13): c or methylated C nucleotide
  modified_base (18)..(18): c or methylated C nucleotide
  modified_base (21)..(21): c or methylated C nucleotide
gagccgggcacccgggccgacga

SEQ ID NO: 1183 - DNA, 21 bp, Artificial
  synthetic oligonucleotide
  modified_base (3)..(3): c or methylated C nucleotide
  modified_base (11)..(11): c or methylated C nucleotide
  modified_base (16)..(16): c or methylated C nucleotide
  modified_base (19)..(19): c or methylated C nucleotide
gccgggcacccgggccgacga

SEQ ID NO: 1184 - DNA, 19 bp, Artificial
  synthetic oligonucleotide
  modified_base (1)..(1): c or methylated C nucleotide
  modified_base (9)..(9): c or methylated C nucleotide
  modified_base (14)..(14): c or methylated C nucleotide
  modified_base (17)..(17): c or methylated C nucleotide
cgggcacccgggccgacga

SEQ ID NO: 1185 - DNA, 17 bp, Artificial
  synthetic oligonucleotide
  modified_base (7)..(7): c or methylated C nucleotide
  modified_base (12)..(12): c or methylated C nucleotide
  modified_base (15)..(15): c or methylated C nucleotide
ggcacccgggccgacga

SEQ ID NO: 1186 - DNA, 15 bp, Artificial
  synthetic oligonucleotide
  modified_base (5)..(5): c or methylated C nucleotide
  modified_base (10)..(10): c or methylated C nucleotide
  modified_base (13)..(13): c or methylated C nucleotide
cacccgggccgacga

SEQ ID NO: 1187 - DNA, 33 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgac

SEQ ID NO: 1188 - DNA, 31 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
gcctggcggcgcgagccgggcacccgggccg

SEQ ID NO: 1189 - DNA, 29 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
gcctggcggcgcgagccgggcacccgggc

SEQ ID NO: 1190 - DNA, 27 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
gcctggcggcgcgagccgggcacccgg

SEQ ID NO: 1191 - DNA, 25 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
gcctggcggcgcgagccgggcaccc

SEQ ID NO: 1192 - DNA, 23 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagccgggcac

SEQ ID NO: 1193 - DNA, 21 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagccgggc

SEQ ID NO: 1194 - DNA, 19 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagccgg

SEQ ID NO: 1195 - DNA, 17 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagcc

SEQ ID NO: 1196 - DNA, 15 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
gcctggcggcgcgag

SEQ ID NO: 1197 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccaggcacccgggccgacga

SEQ ID NO: 1198 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcgccgcgagccgggcacccgggccgacga

SEQ ID NO: 1199 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggcctacga

SEQ ID NO: 1200 - DNA, 33 bp, Artificial; identical to SEQ ID NO: 1089
  synthetic oligonucleotide
  modified_base (4)..(4): c or methylated C nucleotide
  modified_base (9)..(9): c or methylated C nucleotide
  modified_base (31)..(31): c or methylated C nucleotide

SEQ ID NO: 1201 - DNA, 34 bp, Artificial
  synthetic oligonucleotide
  modified_base (5)..(5): c or methylated C nucleotide
  modified_base (10)..(10): c or methylated C nucleotide
  modified_base (32)..(32): c or methylated C nucleotide
tgggcggggcgacctgggatcccaggcctggcgg

SEQ ID NO: 1202 - DNA, 35 bp, Artificial
  synthetic oligonucleotide
  modified_base (6)..(6): c or methylated C nucleotide
  modified_base (11)..(11): c or methylated C nucleotide
  modified_base (33)..(33): c or methylated C nucleotide
ctgggcggggcgacctgggatcccaggcctggcgg

SEQ ID NO: 1203 - DNA, 36 bp, Artificial
  synthetic oligonucleotide
  modified_base (7)..(7): c or methylated C nucleotide
  modified_base (12)..(12): c or methylated C nucleotide
  modified_base (34)..(34): c or methylated C nucleotide
gctgggcggggcgacctgggatcccaggcctggcgg

SEQ ID NO: 1204 - DNA, 37 bp, Artificial
  synthetic oligonucleotide
  modified_base (8)..(8): c or methylated C nucleotide
  modified_base (13)..(13): c or methylated C nucleotide
  modified_base (35)..(35): c or methylated C nucleotide
tgctgggcggggcgacctgggatcccaggcctggcgg

SEQ ID NO: 1205 - DNA, 38 bp, Artificial
  synthetic oligonucleotide
  modified_base (9)..(9): c or methylated C nucleotide
  modified_base (14)..(14): c or methylated C nucleotide
  modified_base (36)..(36): c or methylated C nucleotide
ctgctgggcggggcgacctgggatcccaggcctggcgg

SEQ ID NO: 1206 - DNA, 34 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggc

SEQ ID NO: 1207 - DNA, 35 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcg

SEQ ID NO: 1208 - DNA, 36 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcgc

SEQ ID NO: 1209 - DNA, 37 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcgcg

SEQ ID NO: 1210 - DNA, 38 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcgcga

SEQ ID NO: 1211 - DNA, 35 bp, Artificial
  synthetic oligonucleotide
  modified_base (5)..(5): c or methylated C nucleotide
  modified_base (10)..(10): c or methylated C nucleotide
  modified_base (32)..(32): c or methylated C nucleotide
tgggcggggcgacctgggatcccaggcctggcggc

SEQ ID NO: 1212 - DNA, 37 bp, Artificial
  synthetic oligonucleotide
  modified_base (6)..(6): c or methylated C nucleotide
  modified_base (11)..(11): c or methylated C nucleotide
  modified_base (33)..(33): c or methylated C nucleotide
ctgggcggggcgacctgggatcccaggcctggcggcg

SEQ ID NO: 1213 - DNA, 39 bp, Artificial
  synthetic oligonucleotide
  modified_base (7)..(7): c or methylated C nucleotide
  modified_base (12)..(12): c or methylated C nucleotide
  modified_base (34)..(34): c or methylated C nucleotide
gctgggcggggcgacctgggatcccaggcctggcggcgc

SEQ ID NO: 1214 - DNA, 41 bp, Artificial
  synthetic oligonucleotide
  modified_base (8)..(8): c or methylated C nucleotide
  modified_base (13)..(13): c or methylated C nucleotide
  modified_base (35)..(35): c or methylated C nucleotide
tgctgggcggggcgacctgggatcccaggcctggcggcgcg

SEQ ID NO: 1215 - DNA, 43 bp, Artificial
  synthetic oligonucleotide
  modified_base (9)..(9): c or methylated C nucleotide
  modified_base (14)..(14): c or methylated C nucleotide
  modified_base (36)..(36): c or methylated C nucleotide
ctgctgggcggggcgacctgggatcccaggcctggcggcgcga

SEQ ID NO: 1216 - DNA, 33 bp, Artificial
  synthetic oligonucleotide
  modified_base (7)..(7): c or methylated C nucleotide
  modified_base (12)..(12): c or methylated C nucleotide
gctgggcggggcgacctgggatcccaggcctgg

SEQ ID NO: 1217 - DNA, 33 bp, Artificial
  synthetic oligonucleotide
  modified_base (10)..(10): c or methylated C nucleotide
  modified_base (15)..(15): c or methylated C nucleotide
gctgctgggcggggcgacctgggatcccaggcc

SEQ ID NO: 1218 - DNA, 33 bp, Artificial
  synthetic oligonucleotide
  modified_base (13)..(13): c or methylated C nucleotide
  modified_base (18)..(18): c or methylated C nucleotide
cgggctgctgggcggggcgacctgggatcccag

SEQ ID NO: 1219 - DNA, 34 bp, Artificial
  synthetic oligonucleotide
  modified_base (16)..(16): c or methylated C nucleotide
  modified_base (21)..(21): c or methylated C nucleotide
gcgcgggctgctgggcggggcgacctgggatccc

SEQ ID NO: 1220 - DNA, 34 bp, Artificial
  synthetic oligonucleotide
  modified_base (19)..(19): c or methylated C nucleotide
  modified_base (24)..(24): c or methylated C nucleotide
agggcgcgggctgctgggcggggcgacctgggat

SEQ ID NO: 1221 - DNA, 33 bp, Artificial
  synthetic oligonucleotide
  modified_base (1)..(1): c or methylated C nucleotide
  modified_base (6)..(6): c or methylated C nucleotide
  modified_base (28)..(28): c or methylated C nucleotide
cggggcgacctgggatcccaggcctggcggcgc

SEQ ID NO: 1222 - DNA, 33 bp, Artificial
  synthetic oligonucleotide
  modified_base (3)..(3): c or methylated C nucleotide
  modified_base (25)..(25): c or methylated C nucleotide
ggcgacctgggatcccaggcctggcggcgcgag

SEQ ID NO: 1223 - DNA, 33 bp, Artificial
  synthetic oligonucleotide
  modified_base (22)..(22): c or methylated C nucleotide
gacctgggatcccaggcctggcggcgcgagccg

SEQ ID NO: 1224 - DNA, 33 bp, Artificial
  synthetic oligonucleotide
  modified_base (19)..(19): c or methylated C nucleotide
ctgggatcccaggcctggcggcgcgagccgggc

SEQ ID NO: 1225 - DNA, 33 bp, Artificial
  synthetic oligonucleotide
  modified_base (16)..(16): c or methylated C nucleotide
ggatcccaggcctggcggcgcgagccgggcacc

SEQ ID NO: 1226 - DNA, 31 bp, Artificial
  synthetic oligonucleotide
  modified_base (2)..(2): c or methylated C nucleotide
  modified_base (7)..(7): c or methylated C nucleotide
  modified_base (29)..(29): c or methylated C nucleotide
gcggggcgacctgggatcccaggcctggcgg

SEQ ID NO: 1227 - DNA, 29 bp, Artificial
  synthetic oligonucleotide
  modified_base (5)..(5): c or methylated C nucleotide
  modified_base (27)..(27): c or methylated C nucleotide
ggggcgacctgggatcccaggcctggcgg

SEQ ID NO: 1228 - DNA, 27 bp, Artificial
  synthetic oligonucleotide
  modified_base (3)..(3): c or methylated C nucleotide
  modified_base (25)..(25): c or methylated C nucleotide
ggcgacctgggatcccaggcctggcgg

SEQ ID NO: 1229 - DNA, 25 bp, Artificial
  synthetic oligonucleotide
  modified_base (1)..(1): c or methylated C nucleotide
  modified_base (23)..(23): c or methylated C nucleotide
cgacctgggatcccaggcctggcgg

SEQ ID NO: 1230 - DNA, 23 bp, Artificial
  synthetic oligonucleotide
  modified_base (21)..(21): c or methylated C nucleotide
acctgggatcccaggcctggcgg

SEQ ID NO: 1231 - DNA, 21 bp, Artificial
  synthetic oligonucleotide
  modified_base (19)..(19): c or methylated C nucleotide
ctgggatcccaggcctggcgg

SEQ ID NO: 1232 - DNA, 19 bp, Artificial
  synthetic oligonucleotide
  modified_base (17)..(17): c or methylated C nucleotide
gggatcccaggcctggcgg

SEQ ID NO: 1233 - DNA, 17 bp, Artificial
  synthetic oligonucleotide
  modified_base (15)..(15): c or methylated C nucleotide
gatcccaggcctggcgg

SEQ ID NO: 1234 - DNA, 15 bp, Artificial
  synthetic oligonucleotide
  modified_base (13)..(13): c or methylated C nucleotide
tcccaggcctggcgg

SEQ ID NO: 1235 - DNA, 14 bp, Artificial
  synthetic oligonucleotide
  modified_base (12)..(12): c or methylated C nucleotide
cccaggcctggcgg

SEQ ID NO: 1236 - DNA, 31 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggc

SEQ ID NO: 1237 - DNA, 29 bp, Artificial
  synthetic oligonucleotide
  modified_base (4)..(4): c or methylated C nucleotide
  modified_base (9)..(9): c or methylated C nucleotide
gggcggggcgacctgggatcccaggcctg

SEQ ID NO: 1238 - DNA, 27 bp, Artificial
  synthetic oligonucleotide
  modified_base (4)..(4): c or methylated C nucleotide
  modified_base (9)..(9): c or methylated C nucleotide
gggcggggcgacctgggatcccaggcc

SEQ ID NO: 1239 - DNA, 25 bp, Artificial
  synthetic oligonucleotide
  modified_base (4)..(4): c or methylated C nucleotide
  modified_base (9)..(9): c or methylated C nucleotide
gggcggggcgacctgggatcccagg

SEQ ID NO: 1240 - DNA, 24 bp, Artificial
  synthetic oligonucleotide
  modified_base (4)..(4): c or methylated C nucleotide
  modified_base (9)..(9): c or methylated C nucleotide
gggcggggcgacctgggatcccag

SEQ ID NO: 1241 - DNA, 22 bp, Artificial
  synthetic oligonucleotide
  modified_base (4)..(4): c or methylated C nucleotide
  modified_base (9)..(9): c or methylated C nucleotide
gggcggggcgacctgggatccc

SEQ ID NO: 1242 - DNA, 20 bp, Artificial
  synthetic oligonucleotide
  modified_base (4)..(4): c or methylated C nucleotide
  modified_base (9)..(9): c or methylated C nucleotide
gggcggggcgacctgggatc

SEQ ID NO: 1243 - DNA, 18 bp, Artificial
  synthetic oligonucleotide
  modified_base (4)..(4): c or methylated C nucleotide
  modified_base (9)..(9): c or methylated C nucleotide
gggcggggcgacctggga

SEQ ID NO: 1244 - DNA, 16 bp, Artificial
  synthetic oligonucleotide
  modified_base (4)..(4): c or methylated C nucleotide
  modified_base (9)..(9): c or methylated C nucleotide
gggcggggcgacctgg

SEQ ID NO: 1245 - DNA, 15 bp, Artificial
  synthetic oligonucleotide
  modified_base (4)..(4): c or methylated C nucleotide
  modified_base (9)..(9): c or methylated C nucleotide
gggcggggcgacctg

SEQ ID NO: 1246 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctggcatcccaggcctggcgg

SEQ ID NO: 1247 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgatctgggatcccaggcctggcgg

SEQ ID NO: 1248 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctgccgg

SEQ ID NO: 1249 - DNA, 2026 bp, Artificial
  synthetic oligonucleotide
  misc_feature (1)..(2026): Nucleic acid sequence of part of the bcl-2 gene 59140256-59138244 (Location on Chromosome 18, -strand)
aacatagcaaaagccatctcttaaaaaaaaaaaaaaaaggccaactaagtaaaaattaaaaaaatcataatttggtgtgcttttctggctttttaaagaatgttttgattttagagtaggaatgagacaaaataaagatgtcaggcagggcacagtggctcatgtctgtaatcccagcactttgggaggctgaggcaggcggataacgaggtcaggagttcgagaccagcctggccagtatggcgaaaccccgtctctactaaaaatacaaaaattagcagagcgtagtggcgtgcacgtgtaatcccagctactcaggaggctgaggcagaattgcttgagcctgggaggcagaggttgcagtgagctgagatcgcaccactgcacaccagcctccaagatacaacagagcaagactctgtctcaaaaaaaaaaaaaaagtcatagcatatttgtacacattgtagtactcatttgtcatctttcttgaccccaataatccagtgtccctatatatttgcactcgagccctattaagtaagccgctgtgcttctagaagacctttttcttttcttggtgctttgtcaaagactcttggagataaaaatacacacgtgcaacttgtttgtcctcttgtccttttttgctaggggctattcatgctgattaatttaaaactgtctgcttgcgcgtacacacgtctgcgagtgtgaatgtgtatgtgtgtatctatgtacctcatttgagaaagtgcggccaactaggattggctacgaggcaaaggtggagacctttaggagcccacccaccccagcgttaggacggtgggcctgaaagttactatatggaagtcctcatcgtgtagcactaaaccagtgtaaaaggtgttagggacagagggaaaacattgacttaaactgtcgtaaagcccttgataaaccccttccctggagcgctgagttctgcatggcctgggccacggactaggtgttcaggtggacacgggcggggatgcgcgtgcgtgtgtagtgcgcggacacctaggaagctacttgaaagtaaacaccacgctcggggcgtccctagacattgcttaaaacgtgcagagtcacctgtcttcacagcagggcagcgctgaggtcccactgctgggggcggtggggggcggcattggcctgggtcttcccccggcggccgagcgccggtaacacaacgtgtgtgtgtgtaggcgcgtgtacacactctcatacacggctagaaagggtccaggcgacacacacactcccacatacacggctagaaaaggtccaggcgagacacacacacacacacacacacacacacacactccacacacactcacacggccagaaagggtccaggcggttcccggcgcttttccagcccttgttttcatggcgcaccctcccgccagccgcccccctccgcactccgtcgtccgcccggcccggccgcgtgcggttccccgggagcccccaccccgtcgcggaccccagcgaccaccaagtccgcacgcggcctgccgcaggcctgagcagaaggccccgcgcacacccaccgcgccgcggccgcgcgggaggcctgtgccgcccgcgccacccactggccgggccccgcgggcgcagcggagcgggcgggtggccggcccggacgcgccctccccggccgcggccccgcgcgccatgtgcccccggcgggacgcgccactcccgggcctgccgcggcgcctttaacccgggccagggagcggggcggagggggcggtcgggtggctcagaggagggctctttctttcttctttttttgaatgaaccgtgtgacgttacgcacaggaaaccggtcgggctgtgcagagaatgaagtaagaggacaggcaccacagccccgctcccgcccccttcctcccgcgcccgcccctccgcgccgcctgcccgcccgcccgccgcgctcccgcccgccgctctccgtggccccgccgcgctgccgccgccgccgctgccagcg

SEQ ID NO: 1250 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtg

SEQ ID NO: 1251 - DNA, 24 bp, Artificial
  synthetic oligonucleotide
  misc_feature (1)..(24): 59139245-59139268 (Location on Chromosome 18)
cacgcacgcgcatccccgcccgtg

SEQ ID NO: 1252 - DNA, 23 bp, Artificial
  synthetic oligonucleotide
  modified_base (4)..(4): c or methylated C nucleotide
  modified_base (10)..(10): c or methylated C nucleotide
  modified_base (18)..(18): c or methylated C nucleotide
  modified_base (20)..(20): c or methylated C nucleotide
actcgcagacgtgtgtacgcgca

SEQ ID NO: 1253 - DNA, 23 bp, Artificial
  synthetic oligonucleotide
  misc_feature (1)..(23): 59139560-59139582 (Location on Chromosome 18)
actcgcagacgtgtgtacgcgca

SEQ ID NO: 1254 - DNA, 60 bp, Artificial
  synthetic oligonucleotide
  misc_feature (1)..(60): Nucleic acid sequence of part of the bcl-2 gene, Secondary promoter 59136900-59136959 (Location on Chromosome 18, -strand)
cgggggccaacggcacctctcgccccagctcccaccccacggcccccagagaaagaagag

SEQ ID NO: 1255 - DNA, 34 bp, Artificial
  synthetic oligonucleotide
  misc_feature (1)..(34): FL989 breakpoint  59139078-59139045 (Location on Chromosome 18, -strand)
gcggccgagcgccggtaacacaacgtgtgtgtgt

SEQ ID NO: 1256 - DNA, 15 bp, Artificial
  synthetic oligonucleotide
  misc_feature (1)..(15): BCL2/IGH breakpoint 59139200-59139186 (Location on Chromosome 18, -strand)
acaccacgctcgggg

SEQ ID NO: 1257 - DNA, 17 bp, Artificial
  synthetic oligonucleotide
  misc_feature (1)..(17): BCL2/IGH breakpoint  9138798-59138781 (Location on Chromosome 18, -strand)
cccggccgcgtgcggtt

SEQ ID NO: 1258 - DNA, 15 bp, Artificial
  synthetic oligonucleotide
  misc_feature (1)..(15): BCL2/IGH breakpoint 59137579-59137565(Location on Chromosome 18, -strand)
agcagaagtctggga

SEQ ID NO: 1259 - DNA, 14 bp, Artificial
  synthetic oligonucleotide
  misc_feature (1)..(14): BCL2/IGH breakpoint 59137255-59137241 (Location on Chromosome 18, -strand)
tacttgtagtgtgt

SEQ ID NO: 1260 - DNA, 15 bp, Artificial
  synthetic oligonucleotide
  misc_feature (1)..(15): BCL2/IGLkappa breakpoint 59139029-59139015 (Location on Chromosome 18, -strand)
gtacacactctcata

SEQ ID NO: 1261 - DNA, 15 bp, Artificial
  synthetic oligonucleotide
  misc_feature (1)..(15): BCL2/IGLkappa breakpoint 59138914-59138899 (Location on Chromosome 18, -strand)
acacactccacacac

SEQ ID NO: 1262 - DNA, 15 bp, Artificial
  synthetic oligonucleotide
  misc_feature (1)..(15): BCL2/IGLkappa breakpoint 59138934-59138919 (Location on Chromosome 18, -strand)
acacggccagaaagg

SEQ ID NO: 1263 - DNA, 14 bp, Artificial
  synthetic oligonucleotide
  misc_feature (1)..(14): BCL2/IGLkappa breakpoint 59137928-59137915 (Location on Chromosome 18, -strand)
ggcgggccaggcgc

SEQ ID NO: 1264 - DNA, 15 bp, Artificial
  synthetic oligonucleotide
  misc_feature (1)..(15): BCL2/IGLlamba breakpoint 59138426-59138411 (Location on Chromosome 18, -strand)
tgtgacgttacgcac

SEQ ID NO: 1265 - DNA, 16 bp, Artificial
  synthetic oligonucleotide
  misc_feature (1)..(16): BCL2/IGLlamba breakpoint 59138213-59138198 (Location on Chromosome 18, -strand)
ctgccggcggccgtca

SEQ ID NO: 1266 - DNA, 15 bp, Artificial
  synthetic oligonucleotide
  misc_feature (1)..(15): BCL2/IGLlamba breakpoint 59137963-59137948 (Location on Chromosome 18, -strand)
acacacagcgcgggc

SEQ ID NO: 1267 - DNA, 26 bp, Artificial
  synthetic oligonucleotide
  misc_feature (1)..(26): NBL19 59139326-59139349 (Location on Chromosome 18)
aaggggtttatcaagggctttacgac

SEQ ID NO: 1268 - DNA, 20 bp, Artificial
  synthetic oligonucleotide
  misc_feature (1)..(20): NBL20 59139271-59139291 (Location on Chromosome 18)
cacctgaacacctagtccgt

SEQ ID NO: 1269 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggg

SEQ ID NO: 1270 - DNA, 26 bp, Artificial
  synthetic oligonucleotide
  misc_feature (1)..(26): BL6 59138610-59138635 (Location on Chromosome 18)
cccgcccgctccgctgcgcccgcggg

SEQ ID NO: 1271 - DNA, 28 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (17)..(17): c or methylated C nucleotide
  modified_base (23)..(23): c or methylated C nucleotide
acatggcgcgcggggccgcggccgggga

SEQ ID NO: 1272 - DNA, 28 bp, Artificial
  synthetic oligonucleotide
  misc_feature (1)..(28): BL8a 59138562-59138589 (Location on Chromosome 18)
acatggcgcgcggggccgcggccgggga

SEQ ID NO: 1273 - DNA, 24 bp, Artificial
  synthetic oligonucleotide
  misc_feature (1)..(24): NBL1 59139724-59139747 (Location on Chromosome 18)
gcggcttacttaatagggctcgag

SEQ ID NO: 1274 - DNA, 28 bp, Artificial
  synthetic oligonucleotide
cctcgtagccaatcctagttggccgcac

SEQ ID NO: 1275 - DNA, 24 bp, Artificial
  synthetic oligonucleotide
  misc_feature (1)..(24): 59139436-59139459 (Location on Chromosome 18)
caggcccaccgtcctaacgctggg

SEQ ID NO: 1276 - DNA, 25 bp, Artificial
  synthetic oligonucleotide
  misc_feature (1)..(25): NBL4 59139181-59139205 (Location on Chromosome 18)
gtctagggacgccccgagcgtggtg

SEQ ID NO: 1277 - DNA, 26 bp, Artificial
  synthetic oligonucleotide
  misc_feature (1)..(26): 59139015-59139040 (Location on Chromosome 18)
ccgtgtatgagagtgtgtacacgcgc

SEQ ID NO: 1278 - DNA, 24 bp, Artificial
  synthetic oligonucleotide
  misc_feature (1)..(22): NBL7a 59138881-59138904 (Location on Chromosome 18)
  misc_feature (1)..(24): NBL7a 59138881-59138904 (Location on Chromosome 18)
aaccgcctggaccctttctggccg

SEQ ID NO: 1279 - DNA, 31 bp, Artificial
  synthetic oligonucleotide
  misc_feature (1)..(30): NBL8a 59138810-59138840 (Location on Chromosome 18)
  misc_feature (1)..(31): NBL8a 59138810-59138840 (Location on Chromosome 18)
acgacggagtgcggaggggggcggctggcgg

SEQ ID NO: 1280 - DNA, 23 bp, Artificial
  synthetic oligonucleotide
  misc_feature (1)..(23): NBL9 59138759-59138781 (Location on Chromosome 18)
ccgcgacggggtgggggctcccg

SEQ ID NO: 1281 - DNA, 35 bp, Artificial
  synthetic oligonucleotide
  misc_feature (1)..(35): NBL11a 59138639-59138673 (Location on Chromosome 18)
cggccagtgggtggcgcgggcggcacaggcctccc

SEQ ID NO: 1282 - DNA, 25 bp, Artificial
  synthetic oligonucleotide
  misc_feature (1)..(25): NBL12a 59138521-59138545 (Location on Chromosome 18)
gcgccgcggcaggcccgggagtggc

SEQ ID NO: 1283 - DNA, 34 bp, Artificial
  synthetic oligonucleotide
  misc_feature (1)..(34): NBL14 59138402-59138435 (Location on Chromosome 18)
gcccgaccggtttcctgtgcgtaacgtcacacgg

SEQ ID NO: 1284 - DNA, 30 bp, Artificial
  synthetic oligonucleotide
  misc_feature (1)..(30): NBL15 59139630-59139659 (Location on Chromosome 18)
ggacaagaggacaaacaagttgcacgtgtg

SEQ ID NO: 1285 - DNA, 30 bp, Artificial
  synthetic oligonucleotide
  misc_feature (1)..(30): NBL16 59139393-59139422 (Location on Chromosome 18)
ctggtttagtgctacacgatgaggacttcc

SEQ ID NO: 1286 - DNA, 24 bp, Artificial
  synthetic oligonucleotide
  misc_feature (1)..(24): NBL5a 59139102-59139125 (Location on Chromosome 18)
cgccccccaccgcccccagcagtg

SEQ ID NO: 1287 - DNA, 34 bp, Artificial
  synthetic oligonucleotide
cccgaccgccccctccgccccgctccctggcccg

SEQ ID NO: 1288 - DNA, 24 bp, Artificial
  synthetic oligonucleotide
cacgggcggggatgcgcgtgcgtg

SEQ ID NO: 1289 - DNA, 25 bp, Artificial
  synthetic oligonucleotide
  modified_base (4)..(4): c or methylated C nucleotide
  modified_base (8)..(8): c or methylated C nucleotide
  modified_base (10)..(10): c or methylated C nucleotide
  modified_base (18)..(18): c or methylated C nucleotide
  modified_base (22)..(22): c or methylated C nucleotide
acacgcacgcgcatccccgcccgtg

SEQ ID NO: 1290 - DNA, 25 bp, Artificial
  synthetic oligonucleotide
acacgcacgcgcatccccgcccgtg

SEQ ID NO: 1291 - DNA, 26 bp, Artificial
  synthetic oligonucleotide
  modified_base (5)..(5): c or methylated C nucleotide
  modified_base (9)..(9): c or methylated C nucleotide
  modified_base (11)..(11): c or methylated C nucleotide
  modified_base (19)..(19): c or methylated C nucleotide
  modified_base (23)..(23): c or methylated C nucleotide
cacacgcacgcgcatccccgcccgtg

SEQ ID NO: 1292 - DNA, 26 bp, Artificial
  synthetic oligonucleotide
cacacgcacgcgcatccccgcccgtg

SEQ ID NO: 1293 - DNA, 27 bp, Artificial
  synthetic oligonucleotide
  modified_base (6)..(6): c or methylated C nucleotide
  modified_base (10)..(10): c or methylated C nucleotide
  modified_base (12)..(12): c or methylated C nucleotide
  modified_base (20)..(20): c or methylated C nucleotide
  modified_base (24)..(24): c or methylated C nucleotide
acacacgcacgcgcatccccgcccgtg

SEQ ID NO: 1294 - DNA, 27 bp, Artificial
  synthetic oligonucleotide
acacacgcacgcgcatccccgcccgtg

SEQ ID NO: 1295 - DNA, 28 bp, Artificial
  synthetic oligonucleotide
  modified_base (7)..(7): c or methylated C nucleotide
  modified_base (11)..(11): c or methylated C nucleotide
  modified_base (13)..(13): c or methylated C nucleotide
  modified_base (21)..(21): c or methylated C nucleotide
  modified_base (25)..(25): c or methylated C nucleotide
tacacacgcacgcgcatccccgcccgtg

SEQ ID NO: 1296 - DNA, 28 bp, Artificial
  synthetic oligonucleotide
tacacacgcacgcgcatccccgcccgtg

SEQ ID NO: 1297 - DNA, 29 bp, Artificial
  synthetic oligonucleotide
  modified_base (8)..(8): c or methylated C nucleotide
  modified_base (12)..(12): c or methylated C nucleotide
  modified_base (14)..(14): c or methylated C nucleotide
  modified_base (22)..(22): c or methylated C nucleotide
  modified_base (26)..(26): c or methylated C nucleotide
ctacacacgcacgcgcatccccgcccgtg

SEQ ID NO: 1298 - DNA, 29 bp, Artificial
  synthetic oligonucleotide
ctacacacgcacgcgcatccccgcccgtg

SEQ ID NO: 1299 - DNA, 25 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgt

SEQ ID NO: 1300 - DNA, 25 bp, Artificial
  synthetic oligonucleotide
cacgcacgcgcatccccgcccgtgt

SEQ ID NO: 1301 - DNA, 26 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtc

SEQ ID NO: 1302 - DNA, 26 bp, Artificial
  synthetic oligonucleotide
cacgcacgcgcatccccgcccgtgtc

SEQ ID NO: 1303 - DNA, 27 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtcc

SEQ ID NO: 1304 - DNA, 27 bp, Artificial
  synthetic oligonucleotide
cacgcacgcgcatccccgcccgtgtcc

SEQ ID NO: 1305 - DNA, 28 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtcca

SEQ ID NO: 1306 - DNA, 28 bp, Artificial
  synthetic oligonucleotide
cacgcacgcgcatccccgcccgtgtcca

SEQ ID NO: 1307 - DNA, 29 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtccac

SEQ ID NO: 1308 - DNA, 29 bp, Artificial
  synthetic oligonucleotide
cacgcacgcgcatccccgcccgtgtccac

SEQ ID NO: 1309 - DNA, 26 bp, Artificial
  synthetic oligonucleotide
  modified_base (4)..(4): c or methylated C nucleotide
  modified_base (8)..(8): c or methylated C nucleotide
  modified_base (10)..(10): c or methylated C nucleotide
  modified_base (18)..(18): c or methylated C nucleotide
  modified_base (22)..(22): c or methylated C nucleotide
acacgcacgcgcatccccgcccgtgt

SEQ ID NO: 1310 - DNA, 26 bp, Artificial
  synthetic oligonucleotide
acacgcacgcgcatccccgcccgtgt

SEQ ID NO: 1311 - DNA, 28 bp, Artificial
  synthetic oligonucleotide
  modified_base (5)..(5): c or methylated C nucleotide
  modified_base (9)..(9): c or methylated C nucleotide
  modified_base (11)..(11): c or methylated C nucleotide
  modified_base (19)..(19): c or methylated C nucleotide
  modified_base (23)..(23): c or methylated C nucleotide
cacacgcacgcgcatccccgcccgtgtc

SEQ ID NO: 1312 - DNA, 28 bp, Artificial
  synthetic oligonucleotide
cacacgcacgcgcatccccgcccgtgtc

SEQ ID NO: 1313 - DNA, 30 bp, Artificial
  synthetic oligonucleotide
  modified_base (6)..(6): c or methylated C nucleotide
  modified_base (10)..(10): c or methylated C nucleotide
  modified_base (12)..(12): c or methylated C nucleotide
  modified_base (20)..(20): c or methylated C nucleotide
  modified_base (24)..(24): c or methylated C nucleotide
acacacgcacgcgcatccccgcccgtgtcc

SEQ ID NO: 1314 - DNA, 30 bp, Artificial; identical to SEQ ID NO: 1313
  synthetic oligonucleotide

SEQ ID NO: 1315 - DNA, 32 bp, Artificial
  synthetic oligonucleotide
  modified_base (7)..(7): c or methylated C nucleotide
  modified_base (11)..(11): c or methylated C nucleotide
  modified_base (13)..(13): c or methylated C nucleotide
  modified_base (21)..(21): c or methylated C nucleotide
  modified_base (25)..(25): c or methylated C nucleotide
tacacacgcacgcgcatccccgcccgtgtcca

SEQ ID NO: 1316 - DNA, 32 bp, Artificial; identical to SEQ ID NO: 1315
  synthetic oligonucleotide

SEQ ID NO: 1317 - DNA, 34 bp, Artificial
  synthetic oligonucleotide
  modified_base (8)..(8): c or methylated C nucleotide
  modified_base (12)..(12): c or methylated C nucleotide
  modified_base (14)..(14): c or methylated C nucleotide
  modified_base (22)..(22): c or methylated C nucleotide
  modified_base (26)..(26): c or methylated C nucleotide
ctacacacgcacgcgcatccccgcccgtgtccac

SEQ ID NO: 1318 - DNA, 34 bp, Artificial; identical to SEQ ID NO: 1317
  synthetic oligonucleotide

SEQ ID NO: 1319 - DNA, 24 bp, Artificial
  synthetic oligonucleotide
  modified_base (6)..(6): c or methylated C nucleotide
  modified_base (10)..(10): c or methylated C nucleotide
  modified_base (12)..(12): c or methylated C nucleotide
  modified_base (20)..(20): c or methylated C nucleotide
  modified_base (24)..(24): c or methylated C nucleotide
acacacgcacgcgcatccccgccc

SEQ ID NO: 1320 - DNA, 24 bp, Artificial
  synthetic oligonucleotide
acacacgcacgcgcatccccgccc

SEQ ID NO: 1321 - DNA, 24 bp, Artificial
  synthetic oligonucleotide
  modified_base (9)..(9): c or methylated C nucleotide
  modified_base (13)..(13): c or methylated C nucleotide
  modified_base (15)..(15): c or methylated C nucleotide
  modified_base (23)..(23): c or methylated C nucleotide
actacacacgcacgcgcatccccg

SEQ ID NO: 1322 - DNA, 24 bp, Artificial
  synthetic oligonucleotide
actacacacgcacgcgcatccccg

SEQ ID NO: 1323 - DNA, 24 bp, Artificial
  synthetic oligonucleotide
  modified_base (12)..(12): c or methylated C nucleotide
  modified_base (16)..(16): c or methylated C nucleotide
  modified_base (18)..(18): c or methylated C nucleotide
cgcactacacacgcacgcgcatcc

SEQ ID NO: 1324 - DNA, 24 bp, Artificial
  synthetic oligonucleotide
cgcactacacacgcacgcgcatcc

SEQ ID NO: 1325 - DNA, 24 bp, Artificial
  synthetic oligonucleotide
  modified_base (15)..(15): c or methylated C nucleotide
  modified_base (19)..(19): c or methylated C nucleotide
  modified_base (21)..(21): c or methylated C nucleotide
ccgcgcactacacacgcacgcgca

SEQ ID NO: 1326 - DNA, 24 bp, Artificial
  synthetic oligonucleotide
ccgcgcactacacacgcacgcgca

SEQ ID NO: 1327 - DNA, 24 bp, Artificial
  synthetic oligonucleotide
  modified_base (18)..(18): c or methylated C nucleotide
  modified_base (22)..(22): c or methylated C nucleotide
  modified_base (24)..(24): c or methylated C nucleotide
tgtccgcgcactacacacgcacgc

SEQ ID NO: 1328 - DNA, 24 bp, Artificial
  synthetic oligonucleotide
tgtccgcgcactacacacgcacgc

SEQ ID NO: 1329 - DNA, 24 bp, Artificial
  synthetic oligonucleotide
  modified_base (4)..(4): c or methylated C nucleotide
  modified_base (6)..(6): c or methylated C nucleotide
  modified_base (14)..(14): c or methylated C nucleotide
  modified_base (18)..(18): c or methylated C nucleotide
gcacgcgcatccccgcccgtgtcc

SEQ ID NO: 1330 - DNA, 24 bp, Artificial
  synthetic oligonucleotide
gcacgcgcatccccgcccgtgtcc

SEQ ID NO: 1331 - DNA, 24 bp, Artificial
  synthetic oligonucleotide
  modified_base (1)..(1): c or methylated C nucleotide
  modified_base (3)..(3): c or methylated C nucleotide
  modified_base (11)..(11): c or methylated C nucleotide
  modified_base (15)..(15): c or methylated C nucleotide
cgcgcatccccgcccgtgtccacc

SEQ ID NO: 1332 - DNA, 24 bp, Artificial
  synthetic oligonucleotide
cgcgcatccccgcccgtgtccacc

SEQ ID NO: 1333 - DNA, 24 bp, Artificial
  synthetic oligonucleotide
  modified_base (8)..(8): c or methylated C nucleotide
  modified_base (12)..(12): c or methylated C nucleotide
gcatccccgcccgtgtccacctga

SEQ ID NO: 1334 - DNA, 24 bp, Artificial
  synthetic oligonucleotide
gcatccccgcccgtgtccacctga

SEQ ID NO: 1335 - DNA, 24 bp, Artificial
  synthetic oligonucleotide
  modified_base (5)..(5): c or methylated C nucleotide
  modified_base (9)..(9): c or methylated C nucleotide
tccccgcccgtgtccacctgaaca

SEQ ID NO: 1336 - DNA, 24 bp, Artificial
  synthetic oligonucleotide
tccccgcccgtgtccacctgaaca

SEQ ID NO: 1337 - DNA, 24 bp, Artificial
  synthetic oligonucleotide
  modified_base (2)..(2): c or methylated C nucleotide
  modified_base (6)..(6): c or methylated C nucleotide
ccgcccgtgtccacctgaacacct

SEQ ID NO: 1338 - DNA, 24 bp, Artificial
  synthetic oligonucleotide
ccgcccgtgtccacctgaacacct

SEQ ID NO: 1339 - DNA, 22 bp, Artificial
  synthetic oligonucleotide
  modified_base (1)..(1): c or methylated C nucleotide
  modified_base (5)..(5): c or methylated C nucleotide
  modified_base (7)..(7): c or methylated C nucleotide
  modified_base (15)..(15): c or methylated C nucleotide
  modified_base (19)..(19): c or methylated C nucleotide
cgcacgcgcatccccgcccgtg

SEQ ID NO: 1340 - DNA, 22 bp, Artificial
  synthetic oligonucleotide
cgcacgcgcatccccgcccgtg

SEQ ID NO: 1341 - DNA, 20 bp, Artificial
  synthetic oligonucleotide
  modified_base (3)..(3): c or methylated C nucleotide
  modified_base (5)..(5): c or methylated C nucleotide
  modified_base (13)..(13): c or methylated C nucleotide
  modified_base (17)..(17): c or methylated C nucleotide
cacgcgcatccccgcccgtg

SEQ ID NO: 1342 - DNA, 20 bp, Artificial
  synthetic oligonucleotide
cacgcgcatccccgcccgtg

SEQ ID NO: 1343 - DNA, 18 bp, Artificial
  synthetic oligonucleotide
  modified_base (1)..(1): c or methylated C nucleotide
  modified_base (3)..(3): c or methylated C nucleotide
  modified_base (11)..(11): c or methylated C nucleotide
  modified_base (15)..(15): c or methylated C nucleotide
cgcgcatccccgcccgtg

SEQ ID NO: 1344 - DNA, 18 bp, Artificial
  synthetic oligonucleotide
cgcgcatccccgcccgtg

SEQ ID NO: 1345 - DNA, 16 bp, Artificial
  synthetic oligonucleotide
  modified_base (1)..(1): c or methylated C nucleotide
  modified_base (9)..(9): c or methylated C nucleotide
  modified_base (13)..(13): c or methylated C nucleotide
cgcatccccgcccgtg

SEQ ID NO: 1346 - DNA, 16 bp, Artificial
  synthetic oligonucleotide
cgcatccccgcccgtg

SEQ ID NO: 1347 - DNA, 15 bp, Artificial
  synthetic oligonucleotide
  modified_base (8)..(8): c or methylated C nucleotide
  modified_base (12)..(12): c or methylated C nucleotide
gcatccccgcccgtg

SEQ ID NO: 1348 - DNA, 15 bp, Artificial
  synthetic oligonucleotide
gcatccccgcccgtg

SEQ ID NO: 1349 - DNA, 22 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccg

SEQ ID NO: 1350 - DNA, 22 bp, Artificial
  synthetic oligonucleotide
cacgcacgcgcatccccgcccg

SEQ ID NO: 1351 - DNA, 20 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
cacgcacgcgcatccccgcc

SEQ ID NO: 1352 - DNA, 20 bp, Artificial
  synthetic oligonucleotide
cacgcacgcgcatccccgcc

SEQ ID NO: 1353 - DNA, 18 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
cacgcacgcgcatccccg

SEQ ID NO: 1354 - DNA, 18 bp, Artificial
  synthetic oligonucleotide
cacgcacgcgcatccccg

SEQ ID NO: 1355 - DNA, 16 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
cacgcacgcgcatccc

SEQ ID NO: 1356 - DNA, 16 bp, Artificial
  synthetic oligonucleotide
cacgcacgcgcatccc

SEQ ID NO: 1357 - DNA, 15 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
cacgcacgcgcatcc

SEQ ID NO: 1358 - DNA, 15 bp, Artificial
  synthetic oligonucleotide
cacgcacgcgcatcc

SEQ ID NO: 1359 - DNA, 25 bp, Artificial
  synthetic oligonucleotide
ccgcgggcgcagcggagcgggcggg

SEQ ID NO: 1360 - DNA, 27 bp, Artificial
  synthetic oligonucleotide
  modified_base (4)..(4): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (22)..(22): c or methylated C nucleotide
  modified_base (24)..(24): c or methylated C nucleotide
acccgcccgctccgctgcgcccgcggg

SEQ ID NO: 1361 - DNA, 27 bp, Artificial
  synthetic oligonucleotide
acccgcccgctccgctgcgcccgcggg

SEQ ID NO: 1362 - DNA, 28 bp, Artificial
  synthetic oligonucleotide
  modified_base (5)..(5): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (23)..(23): c or methylated C nucleotide
  modified_base (25)..(25): c or methylated C nucleotide
cacccgcccgctccgctgcgcccgcggg

SEQ ID NO: 1363 - DNA, 28 bp, Artificial
  synthetic oligonucleotide
cacccgcccgctccgctgcgcccgcggg

SEQ ID NO: 1364 - DNA, 29 bp, Artificial
  synthetic oligonucleotide
  modified_base (6)..(6): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (24)..(24): c or methylated C nucleotide
  modified_base (26)..(26): c or methylated C nucleotide
ccacccgcccgctccgctgcgcccgcggg

SEQ ID NO: 1365 - DNA, 29 bp, Artificial
  synthetic oligonucleotide
ccacccgcccgctccgctgcgcccgcggg

SEQ ID NO: 1366 - DNA, 30 bp, Artificial
  synthetic oligonucleotide
  modified_base (7)..(7): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (25)..(25): c or methylated C nucleotide
  modified_base (27)..(27): c or methylated C nucleotide
gccacccgcccgctccgctgcgcccgcggg

SEQ ID NO: 1367 - DNA, 30 bp, Artificial; identical to SEQ ID NO: 1366
  synthetic oligonucleotide

SEQ ID NO: 1368 - DNA, 31 bp, Artificial
  synthetic oligonucleotide
  modified_base (8)..(8): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (26)..(26): c or methylated C nucleotide
  modified_base (28)..(28): c or methylated C nucleotide
ggccacccgcccgctccgctgcgcccgcggg

SEQ ID NO: 1369 - DNA, 31 bp, Artificial; identical to SEQ ID NO: 1368
  synthetic oligonucleotide

SEQ ID NO: 1370 - DNA, 27 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcgggg

SEQ ID NO: 1371 - DNA, 27 bp, Artificial
  synthetic oligonucleotide
cccgcccgctccgctgcgcccgcgggg

SEQ ID NO: 1372 - DNA, 28 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggc

SEQ ID NO: 1373 - DNA, 28 bp, Artificial
  synthetic oligonucleotide
cccgcccgctccgctgcgcccgcggggc

SEQ ID NO: 1374 - DNA, 29 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggcc

SEQ ID NO: 1375 - DNA, 29 bp, Artificial
  synthetic oligonucleotide
cccgcccgctccgctgcgcccgcggggcc

SEQ ID NO: 1376 - DNA, 30 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggccc

SEQ ID NO: 1377 - DNA, 30 bp, Artificial; identical to SEQ ID NO: 1376
  synthetic oligonucleotide

SEQ ID NO: 1378 - DNA, 31 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggcccg

SEQ ID NO: 1379 - DNA, 31 bp, Artificial; identical to SEQ ID NO: 1378
  synthetic oligonucleotide

SEQ ID NO: 1380 - DNA, 28 bp, Artificial
  synthetic oligonucleotide
  modified_base (4)..(4): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (22)..(22): c or methylated C nucleotide
  modified_base (24)..(24): c or methylated C nucleotide
acccgcccgctccgctgcgcccgcgggg

SEQ ID NO: 1381 - DNA, 28 bp, Artificial
  synthetic oligonucleotide
acccgcccgctccgctgcgcccgcgggg

SEQ ID NO: 1382 - DNA, 30 bp, Artificial
  synthetic oligonucleotide
  modified_base (5)..(5): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (23)..(23): c or methylated C nucleotide
  modified_base (25)..(25): c or methylated C nucleotide
cacccgcccgctccgctgcgcccgcggggc

SEQ ID NO: 1383 - DNA, 30 bp, Artificial; identical to SEQ ID NO: 1382
  synthetic oligonucleotide

SEQ ID NO: 1384 - DNA, 32 bp, Artificial
  synthetic oligonucleotide
  modified_base (6)..(6): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (24)..(24): c or methylated C nucleotide
  modified_base (26)..(26): c or methylated C nucleotide
ccacccgcccgctccgctgcgcccgcggggcc

SEQ ID NO: 1385 - DNA, 32 bp, Artificial; identical to SEQ ID NO: 1384
  synthetic oligonucleotide

SEQ ID NO: 1386 - DNA, 34 bp, Artificial
  synthetic oligonucleotide
  modified_base (7)..(7): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (25)..(25): c or methylated C nucleotide
  modified_base (27)..(27): c or methylated C nucleotide
gccacccgcccgctccgctgcgcccgcggggccc

SEQ ID NO: 1387 - DNA, 34 bp, Artificial; identical to SEQ ID NO: 1386
  synthetic oligonucleotide

SEQ ID NO: 1388 - DNA, 36 bp, Artificial
  synthetic oligonucleotide
  modified_base (8)..(8): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (26)..(26): c or methylated C nucleotide
  modified_base (28)..(28): c or methylated C nucleotide
ggccacccgcccgctccgctgcgcccgcggggcccg

SEQ ID NO: 1389 - DNA, 36 bp, Artificial; identical to SEQ ID NO: 1388
  synthetic oligonucleotide

SEQ ID NO: 1390 - DNA, 26 bp, Artificial
  synthetic oligonucleotide
  modified_base (6)..(6): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (24)..(24): c or methylated C nucleotide
  modified_base (26)..(26): c or methylated C nucleotide
ccacccgcccgctccgctgcgcccgc

SEQ ID NO: 1391 - DNA, 26 bp, Artificial
  synthetic oligonucleotide
ccacccgcccgctccgctgcgcccgc

SEQ ID NO: 1392 - DNA, 26 bp, Artificial
  synthetic oligonucleotide
  modified_base (9)..(9): c or methylated C nucleotide
  modified_base (13)..(13): c or methylated C nucleotide
  modified_base (18)..(18): c or methylated C nucleotide
  modified_base (23)..(23): c or methylated C nucleotide
cggccacccgcccgctccgctgcgcc

SEQ ID NO: 1393 - DNA, 26 bp, Artificial
  synthetic oligonucleotide
cggccacccgcccgctccgctgcgcc

SEQ ID NO: 1394 - DNA, 26 bp, Artificial
  synthetic oligonucleotide
  modified_base (12)..(12): c or methylated C nucleotide
  modified_base (16)..(16): c or methylated C nucleotide
  modified_base (21)..(21): c or methylated C nucleotide
  modified_base (26)..(26): c or methylated C nucleotide
ggccggccacccgcccgctccgctgc

SEQ ID NO: 1395 - DNA, 26 bp, Artificial
  synthetic oligonucleotide
ggccggccacccgcccgctccgctgc

SEQ ID NO: 1396 - DNA, 26 bp, Artificial
  synthetic oligonucleotide
  modified_base (15)..(15): c or methylated C nucleotide
  modified_base (19)..(19): c or methylated C nucleotide
  modified_base (24)..(24): c or methylated C nucleotide
ccgggccggccacccgcccgctccgc

SEQ ID NO: 1397 - DNA, 26 bp, Artificial
  synthetic oligonucleotide
ccgggccggccacccgcccgctccgc

SEQ ID NO: 1398 - DNA, 26 bp, Artificial
  synthetic oligonucleotide
  modified_base (18)..(18): c or methylated C nucleotide
  modified_base (22)..(22): c or methylated C nucleotide
cgtccgggccggccacccgcccgctc

SEQ ID NO: 1399 - DNA, 26 bp, Artificial
  synthetic oligonucleotide
cgtccgggccggccacccgcccgctc

SEQ ID NO: 1400 - DNA, 26 bp, Artificial
  synthetic oligonucleotide
  modified_base (4)..(4): c or methylated C nucleotide
  modified_base (9)..(9): c or methylated C nucleotide
  modified_base (14)..(14): c or methylated C nucleotide
  modified_base (18)..(18): c or methylated C nucleotide
  modified_base (20)..(20): c or methylated C nucleotide
gcccgctccgctgcgcccgcggggcc

SEQ ID NO: 1401 - DNA, 26 bp, Artificial
  synthetic oligonucleotide
gcccgctccgctgcgcccgcggggcc

SEQ ID NO: 1402 - DNA, 26 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (15)..(15): c or methylated C nucleotide
  modified_base (17)..(17): c or methylated C nucleotide
cgctccgctgcgcccgcggggcccgg

SEQ ID NO: 1403 - DNA, 26 bp, Artificial
  synthetic oligonucleotide
cgctccgctgcgcccgcggggcccgg

SEQ ID NO: 1404 - DNA, 26 bp, Artificial
  synthetic oligonucleotide
  modified_base (3)..(3): c or methylated C nucleotide
  modified_base (8)..(8): c or methylated C nucleotide
  modified_base (12)..(12): c or methylated C nucleotide
  modified_base (14)..(14): c or methylated C nucleotide
tccgctgcgcccgcggggcccggcca

SEQ ID NO: 1405 - DNA, 26 bp, Artificial
  synthetic oligonucleotide
tccgctgcgcccgcggggcccggcca

SEQ ID NO: 1406 - DNA, 26 bp, Artificial
  synthetic oligonucleotide
  modified_base (5)..(5): c or methylated C nucleotide
  modified_base (9)..(9): c or methylated C nucleotide
  modified_base (11)..(11): c or methylated C nucleotide
gctgcgcccgcggggcccggccagtg

SEQ ID NO: 1407 - DNA, 26 bp, Artificial
  synthetic oligonucleotide
gctgcgcccgcggggcccggccagtg

SEQ ID NO: 1408 - DNA, 26 bp, Artificial
  synthetic oligonucleotide
  modified_base (2)..(2): c or methylated C nucleotide
  modified_base (8)..(8): c or methylated C nucleotide
gcgcccgcggggcccggccagtgggt

SEQ ID NO: 1409 - DNA, 26 bp, Artificial
  synthetic oligonucleotide
gcgcccgcggggcccggccagtgggt

SEQ ID NO: 1410 - DNA, 24 bp, Artificial
  synthetic oligonucleotide
  modified_base (1)..(1): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (19)..(19): c or methylated C nucleotide
  modified_base (21)..(21): c or methylated C nucleotide
cgcccgctccgctgcgcccgcggg

SEQ ID NO: 1411 - DNA, 24 bp, Artificial
  synthetic oligonucleotide
cgcccgctccgctgcgcccgcggg

SEQ ID NO: 1412 - DNA, 22 bp, Artificial
  synthetic oligonucleotide
  modified_base (3)..(3): c or methylated C nucleotide
  modified_base (8)..(8): c or methylated C nucleotide
  modified_base (13)..(13): c or methylated C nucleotide
  modified_base (17)..(17): c or methylated C nucleotide
  modified_base (19)..(19): c or methylated C nucleotide
cccgctccgctgcgcccgcggg

SEQ ID NO: 1413 - DNA, 22 bp, Artificial
  synthetic oligonucleotide
cccgctccgctgcgcccgcggg

SEQ ID NO: 1414 - DNA, 20 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (15)..(15): c or methylated C nucleotide
  modified_base (17)..(17): c or methylated C nucleotide
cgctccgctgcgcccgcggg

SEQ ID NO: 1415 - DNA, 20 bp, Artificial
  synthetic oligonucleotide
cgctccgctgcgcccgcggg

SEQ ID NO: 1416 - DNA, 18 bp, Artificial
  synthetic oligonucleotide
  modified_base (4)..(4): c or methylated C nucleotide
  modified_base (9)..(9): c or methylated C nucleotide
  modified_base (13)..(13): c or methylated C nucleotide
  modified_base (15)..(15): c or methylated C nucleotide
ctccgctgcgcccgcggg

SEQ ID NO: 1417 - DNA, 18 bp, Artificial
  synthetic oligonucleotide
ctccgctgcgcccgcggg

SEQ ID NO: 1418 - DNA, 16 bp, Artificial
  synthetic oligonucleotide
  modified_base (2)..(2): c or methylated C nucleotide
  modified_base (7)..(7): c or methylated C nucleotide
  modified_base (11)..(11): c or methylated C nucleotide
  modified_base (13)..(13): c or methylated C nucleotide
ccgctgcgcccgcggg

SEQ ID NO: 1419 - DNA, 16 bp, Artificial
  synthetic oligonucleotide
ccgctgcgcccgcggg

SEQ ID NO: 1420 - DNA, 15 bp, Artificial
  synthetic oligonucleotide
  modified_base (1)..(1): c or methylated C nucleotide
  modified_base (6)..(6): c or methylated C nucleotide
  modified_base (10)..(10): c or methylated C nucleotide
  modified_base (12)..(12): c or methylated C nucleotide
cgctgcgcccgcggg

SEQ ID NO: 1421 - DNA, 15 bp, Artificial
  synthetic oligonucleotide
cgctgcgcccgcggg

SEQ ID NO: 1422 - DNA, 24 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcg

SEQ ID NO: 1423 - DNA, 24 bp, Artificial
  synthetic oligonucleotide
cccgcccgctccgctgcgcccgcg

SEQ ID NO: 1424 - DNA, 22 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
cccgcccgctccgctgcgcccg

SEQ ID NO: 1425 - DNA, 22 bp, Artificial
  synthetic oligonucleotide
cccgcccgctccgctgcgcccg

SEQ ID NO: 1426 - DNA, 20 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
cccgcccgctccgctgcgcc

SEQ ID NO: 1427 - DNA, 20 bp, Artificial
  synthetic oligonucleotide
cccgcccgctccgctgcgcc

SEQ ID NO: 1428 - DNA, 18 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
cccgcccgctccgctgcg

SEQ ID NO: 1429 - DNA, 18 bp, Artificial
  synthetic oligonucleotide
cccgcccgctccgctgcg

SEQ ID NO: 1430 - DNA, 16 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
cccgcccgctccgctg

SEQ ID NO: 1431 - DNA, 16 bp, Artificial
  synthetic oligonucleotide
cccgcccgctccgctg

SEQ ID NO: 1432 - DNA, 15 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
cccgcccgctccgct

SEQ ID NO: 1433 - DNA, 15 bp, Artificial
  synthetic oligonucleotide
cccgcccgctccgct

SEQ ID NO: 1434 - DNA, 21 bp, Artificial
  synthetic oligonucleotide
  modified_base (12)..(12): c or methylated C nucleotide
  modified_base (14)..(14): c or methylated C nucleotide
  modified_base (16)..(16): c or methylated C nucleotide
ggggcacatggcgcgcggggc

SEQ ID NO: 1435 - DNA, 21 bp, Artificial
  synthetic oligonucleotide
  misc_feature (1)..(21): BL7-3 59138557-59138577 (Location on chromosome 18)
ggggcacatggcgcgcggggc

SEQ ID NO: 1436 - DNA, 21 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
ccgggggcacatggcgcgcgg

SEQ ID NO: 1437 - DNA, 21 bp, Artificial
  synthetic oligonucleotide
  misc_feature (1)..(21): BL7-4 59138554-59138574 (Location on chromosome 18)
ccgggggcacatggcgcgcgg

SEQ ID NO: 1438 - DNA, 27 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (26)..(26): c or methylated C nucleotide
gccgggggcacatggcgcgcggggccg

SEQ ID NO: 1439 - DNA, 27 bp, Artificial
  synthetic oligonucleotide
gccgggggcacatggcgcgcggggccg

SEQ ID NO: 1440 - DNA, 27 bp, Artificial
  synthetic oligonucleotide
  modified_base (19)..(19): c or methylated C nucleotide
  modified_base (21)..(21): c or methylated C nucleotide
  modified_base (23)..(23): c or methylated C nucleotide
cccgccgggggcacatggcgcgcgggg

SEQ ID NO: 1441 - DNA, 27 bp, Artificial
  synthetic oligonucleotide
cccgccgggggcacatggcgcgcgggg

SEQ ID NO: 1442 - DNA, 27 bp, Artificial
  synthetic oligonucleotide
  modified_base (22)..(22): c or methylated C nucleotide
  modified_base (24)..(24): c or methylated C nucleotide
  modified_base (26)..(26): c or methylated C nucleotide
cgtcccgccgggggcacatggcgcgcg

SEQ ID NO: 1443 - DNA, 27 bp, Artificial
  synthetic oligonucleotide
cgtcccgccgggggcacatggcgcgcg

SEQ ID NO: 1444 - DNA, 17 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (17)..(17): c or methylated C nucleotide
acatggcgcgcggggcc

SEQ ID NO: 1445 - DNA, 17 bp, Artificial
  synthetic oligonucleotide
acatggcgcgcggggcc

SEQ ID NO: 1446 - DNA, 15 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
acatggcgcgcgggg

SEQ ID NO: 1447 - DNA, 15 bp, Artificial
  synthetic oligonucleotide
acatggcgcgcgggg

SEQ ID NO: 1448 - DNA, 24 bp, Artificial
  synthetic oligonucleotide
  misc_feature (1)..(24): n= a, c, g, or t
nnnnnnnnnnnnnnnnnnnnnnnn

SEQ ID NO: 1449 - DNA, 24 bp, Artificial
  synthetic oligonucleotide
cacgcacgcgcatccccgccagtg

SEQ ID NO: 1450 - DNA, 27 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (17)..(17): c or methylated C nucleotide
  modified_base (22)..(22): c or methylated C nucleotide
acatggcgcgcggggccgggccgggga

SEQ ID NO: 1451 - DNA, 27 bp, Artificial
  synthetic oligonucleotide
acatggcgcgcggggccgggccgggga

SEQ ID NO: 1452 - DNA, 21 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (13)..(13): c or methylated C nucleotide
  modified_base (18)..(18): c or methylated C nucleotide
ggcgcgcggggccgggccggg

SEQ ID NO: 1453 - DNA, 21 bp, Artificial
  synthetic oligonucleotide
ggcgcgcggggccgggccggg

SEQ ID NO: 1454 - DNA, 32 bp, Artificial
  synthetic oligonucleotide
gcgccgccaaccgcctggaccctttctggccg

SEQ ID NO: 1455 - DNA, 34 bp, Artificial
  synthetic oligonucleotide
cgcacgacggagtgcggaggggggcggctggcgg

SEQ ID NO: 1456 - DNA, 42 bp, Artificial
  synthetic oligonucleotide
cggccagtgggtggcgcgggcggcacaggcctccccgcgggc

SEQ ID NO: 1457 - DNA, 35 bp, Artificial
  synthetic oligonucleotide
gcgccgcggcaggcccgggagtggccgtcccgccg

SEQ ID NO: 1458 - DNA, 32 bp, Artificial
  synthetic oligonucleotide
cagggaaaggggtttatcaagggctttacgac

SEQ ID NO: 1459 - DNA, 29 bp, Artificial
  synthetic oligonucleotide
cacctgaacacctagtccgtgcccaggcc

SEQ ID NO: 1460 - DNA, 36 bp, Artificial
  synthetic oligonucleotide
cgccccccaccgcccccagcagtgagacctcagcgc

SEQ ID NO: 1461 - DNA, 36 bp, Artificial
  synthetic oligonucleotide
accccgaccgccccctccgccccgctccctggcccg

SEQ ID NO: 1462 - DNA, 21 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (16)..(16): c or methylated C nucleotide
  modified_base (21)..(21): c or methylated C nucleotide
catggcgcgcggggccgggcc

SEQ ID NO: 1463 - DNA, 21 bp, Artificial
  synthetic oligonucleotide
catggcgcgcggggccgggcc

SEQ ID NO: 1464 - DNA, 21 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (19)..(19): c or methylated C nucleotide
gcacatggcgcgcggggccgg

SEQ ID NO: 1465 - DNA, 21 bp, Artificial
  synthetic oligonucleotide
gcacatggcgcgcggggccgg

SEQ ID NO: 1466 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgtatccccgcccgtg

SEQ ID NO: 1467 - DNA, 24 bp, Artificial
  synthetic oligonucleotide
cacgcacgcgtatccccgcccgtg

SEQ ID NO: 1468 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcgcgcgcatccccgcccgtg

SEQ ID NO: 1469 - DNA, 24 bp, Artificial
  synthetic oligonucleotide
cacgcgcgcgcatccccgcccgtg

SEQ ID NO: 1470 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgaccgtg

SEQ ID NO: 1471 - DNA, 24 bp, Artificial
  synthetic oligonucleotide
cacgcacgcgcatccccgaccgtg

SEQ ID NO: 1472 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgccccgctgcgcccgcggg

SEQ ID NO: 1473 - DNA, 26 bp, Artificial
  synthetic oligonucleotide
cccgcccgccccgctgcgcccgcggg

SEQ ID NO: 1474 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgtccgctccgctgcgcccgcggg

SEQ ID NO: 1475 - DNA, 26 bp, Artificial
  synthetic oligonucleotide
cccgtccgctccgctgcgcccgcggg

SEQ ID NO: 1476 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcggccgcggg

SEQ ID NO: 1477 - DNA, 26 bp, Artificial
  synthetic oligonucleotide
cccgcccgctccgctgcggccgcggg

SEQ ID NO: 1478 - DNA, 150 bp, Artificial
  synthetic oligonucleotide
  misc_feature (1)..(150): TGF-alpha promoter region
atttgccaagcagactctgaccttttccctcttctcctccacccaacaggtattgtgttggctgcgtgccaggccttggagaacagcacgtccccgctgagtggtgagtgcagctgccgtgggtgtgtggatcgtgtgtgggaagggagc

SEQ ID NO: 1479 - DNA, 200 bp, Artificial
  synthetic oligonucleotide
  misc_feature (1)..(200)
  misc_feature (1)..(200): TGF-alpha promoter region
ctggtagggtgggaggtgtggggtttgcatgtcagctgttcctggatctgagccctgcatctttcctctccccagcagacccgcccgtggctgcagcagtggtgtcccattttaatgactgcccagattcccacactcagttctgcttccatggaacctgcaggtttttggtgcaggaggacaagccagcatgtgtgtaa

What is claimed is:

1. A pharmaceutical composition comprising:
   an oligonucleotide and an immunotherapeutic agent,
   wherein the oligonucleotide comprises an oligomer consisting of SEQ ID NOs:1250 or 1251 and the immunotherapeutic agent is rituximab.

2. The composition of claim 1, wherein the oligonucleotide comprises SEQ ID NO:1251.

3. The composition of claim 2, further comprising an additional oligonucleotide.

4. The composition of claim 3, wherein the additional oligonucleotide consists of SEQ ID NO:1250.

5. The composition of claim 1 wherein the oligonucleotide has a phosphorothiolate backbone.

* * * * *